United States Patent 9,644,005 (DIDEMNIN BIOSYNTHETIC GENE CLUSTER IN TISTRELLA MOBILIS) - sequence listing, part 3

SEQ ID NO: 64 - DNA, 690188 bp, Tistrella mobilis
atgaaggcgctcacctggcacggcaagggcgatatccgctgcgaaaccgttcccgatcccgccatcgaacacggccgggacgcgatcatccgcgtcagctcctgcgcgatctgcggatcggatctgcacctctttgacggggtgatgccgtcgatgcatcatggcgacgtgctggggcatgaagcgatgggcgaggtggtagaggtcgggcgcgacaatcaggcgctgtcggtcggcgatcgggtggtggtgcccttcaccatctcctgcggcgaatgcttcttctgccggcgcggtttcttctcgggctgcgagcgctccaaccccaatgcggccgatgcgaagaagctctgggggcagtccccggcggggctgttcggctattcccacctgctgggcggctatgccggggggcaggcggaatatctgcgcgtgccctatgccgatgtcgggccgatccgggtgccggatggcatgcccgatgaacaggcgctgttcctgtcggatatcttccccaccggctatatggcggccgggttctgcgacatccagcccgacgacaccattgcggtctggggctgcgggccggtcgggcagatggcgatccgcagcgcctttctgctgggggccggccgggtgatcgccatcgacaccgtgcccgagcgtctggccatggcacaggccgccggggcgctgacgctcgacttcatggccgaggacatctacgaccggatccaggaactgacccgcggccgcggcgccgatgcctgcatcgacgctgtcggcaccgagcccgagaccagaagcggcctcgatgccgtgatcgaccgggtgaaggttgcagccttcatgggcaccgaccggccgcatgtgctgcgtcaggcgatccaatgctgccgcaatttcggcacggtctcgatcgtgggcgtctatggcgggctgctcgacaagatcccgatgggttcggcgatcaatcgcggcctgaccttccgcatggcccagacgccggtgcagcgctatctgccgcggctggtggaactgatcacctcgggccgcttcgatccctctttcgtggtcacccatcaggccgggctggatgccgggcccgatctctatgccaccttccgcgacaaggccgatggctgcgtgaaggtgatgctgcggccctgagcccgccccggttctgaccgacacgcttcccctctacccggccccgttctcttcctctgccgtcggcggttcgcactccagcaccacccgatatccctggttgtccagcgtatgggtggcggtgaccaccgaccagcggccatccaccggcgtgcggatgcctgagacctcgaccggtgtttcggcccgcagcgccgcatcgccgggaagggtgaggcgcagccgacgacgggcgcgttctgcggcttcgccggcggcctgggcggcggcccgggcgtcctctgccgaggcgaagctgcgccggagcgtgcgtgccggggccgatggatcggcaccgggcacctccacccgttccgatcgccgttccccggttgcggtatcggtataggcggcgatcaccgcgccatgggccgggcgttcggtctgggacagcgcccagtcggtcagcctttcggccggcagggcgatcgggtcgagcagctcgccgccggcgctgcggccgcgcgcggcagagacaaacagcagccggccggccaccggcttcgccaccgcgtcatgatccttcgccagccgggtcagcaggttcaggtcgctctcacccgtctggtctacccgggtcagaacccggccggccagatcttcggacacgcgcggtgtcagcccgtgacggccggcgatcccggcgaccaggtcgccgatcgtgatccggtcgcgccccagggtgcgcggctccttcaggctggcggcaaaggcggcggcgctggcgatgatcgtcatgcgggccggcgggccggcatgttccagcccgtcgacctgaaaccggcccatcagctcgggccggcccagccccagccagaggctgaggtcgacgccggttcgcggccaggcgatgcggctgtcgcggtcgtcgagcacgatccgcagcgtgtcggcatgcatgccggcggcatcgctgaccgtcagcgagatcagccggtcggcgagcagcggggtgagatcggcatcccccgccgtcagacggaaaatcgggcgcatcagtcccagagcctcacccgttcgcgcgccaccggaatggtgcgtccggccgtcgctcgcggcagatcgggcagcagcacggcaaggttggcaggatagaccgggcccttcgcggccaggcccggattggcggccagcacctcggccaccacgtcatggcggccgtaatgccgccagcagatgcggtcgagcacatcgccgtcgatggtgcggtagagcgtggtcatgcggcctccgaggtggggtcgtcctcgccataataggcgagcgaaatctgcagatcgatcgcccgggcaaggccgcccggcccgaagacccggccggtctcatcgatgcgggtgatgacccagaagcccagcacgcggccgtcggacagggtgaagagcagcggctgcccttcggctgccatcgcacgcagctgctcgatctggccggtcccgccgcgccaccagggatgaagggtggccggcagggtgatctcgtcggtgccggggcccacatattgcagggcaggggcgcggccgatccggtcctgtgccggccaccgccaggcggttgcgcggcggagttcagtataggccaccgtggacaggccgaagccgaaccggccgagccgggcaagctgggccggtacgatgccggccgcctcggcgatgccgccgagcgccgccgccaccccgggcgggacatagatggtcgccgccacctgcgcgacgacgccatctgccgccgccatcgcgctccggacccggccgtgaagatccagccggccggcggcccggcccagcatcgcccccagatccgatcccgccgccatgccgtccggcagcccgtcgcgtgccacgctttccagcgcggccagcatcgggtcggcagctccgggggcaagaccgttcatccagccgagcatcaccccggctgtggcatcggcccgaccctggccgcgcagcatcacctgggcggcggccccgaccgcgtcgaccagcgccatgcctttcagccccagccgcggcgctgccgccagaagccgcggcagatcggccgcgagtgcccgcatcgcgactggccgatcgccggtcccgtcgtcggcggtgagggtggattgcagcagccggtcccaggcggcggccatatcgctgcccgggatcttcgcctgctgcatcaggctcgccgacaccgcaatcgtctcgtcgagcgccaccccggccgcgagggccgcaagcgccgagggcctgagggccagcagggcgccggacagcgccgtgccgcggccgacaagccaggtcagcgccccggtcagggcatcggggtcctgaccgctttccgcctggatgcggaggatggcggaaacggtgtcgtcgaaggcgcgacgctgggccgcagtggcgccgccgccgggttccagcagatggggggcaacgcccaccagggcggcgatgcggcgccggatgcccggatcagagatcgtggtcataaagcactccccagtcattgttcaggacgccctgccggaattccgacgcgatgcgctggccatcggcggggccggtgacgttgatcgtcacgttccaggtgtggctgatggcgggtggtgtatggccggtggcagtcatgaccggttgaggcggcatcagttgtggcaggggcgccacctgctcttcggtcccgtcctgacggatgatcccaccgtcgaaggagggcatgggcagagagacgacgttgccgtgcgaacccgcccgatcggtgctggccccgctcaaaagctcgttgccggttgcgacgatatcgtcccagaagtagacgatgaggccggttgcggccagggctgccagaacctggggtttggcgacggttgacatgaccacggggccgataagaggcatcaaccagcgcatgatcccggcgccgctacccagtcgggcgatcagaccgccagccgtctttgccaccccgccgacccggcccgccacgccgccgaccgttcccgccaccgtcgcagtacccgcggccaggaccagtgccgaggtcagcccgggcatggcctcgatcagccggttgatgccgttcagcaggtcggtcaccacgtcggcgatgcgggcaagatccggttccatcgcagtcaacagggtggatacgctgccttcccaggcggcggtcatgcgctggacggaaccgccagcgctttcgcccacacgcgccgccgccgcttccagcgatcccggcggtgcgccctgtgccacgccgccgcgcccgggcaggccggcacctgcgctcagcacgctggtgcgcagccgatcgtaatcttcgccgccggtcatcaggcgagcggctgtgctggccgccagttcatcgccgaacagcgcatccagatccggcagattgccgccggtcgcgcggcggatgtcgtcgagcacccggcgcagcggatcggcgcccgttgcctgtgcagcctggaccgcggcccggatatcgacgcccagcgcatcggcacgtgtcgacaccgcccggcttttcagcgcctgcagcagggcggccatgccagcggtcgcttcggcaccgtcagcgcctgcgatctgaagggcggcggccaggctggcgacgccgccggtaccggtcagaccgatcccggctgccgtgccggcaagggcgggcagggcagggacggcgctgcggaagtcggtgacccggcccgccacgccggcacggttcagcatctcgaaggcgatgccgatctctgccggatccagtgccatctcgcgggcgaggccgatggcgccgccggtcagcgcctccaccccggcgccggtggcctgatcggtccgggcgatcacctgcacggtttccagcgccccggccgggtcggtgcggttacgcaccagcacctcgaaggcggcggtgagacgggctgcatctccgccggtctgtgtcgccgtctcgttcagcggcgctatatagctcgtcagggtgtcgggtgcggtgccggtgatcgtggccagcctctgcagccgggtcgagacctcgatcgcggggcccattgcgttcagaatgcccgaggcaaagccggtcacccgccccagatcgtcataggtctggcgaatgccctcgccatagcgccgcaccgccgcggcgatcacctcggcgcggtcggcagctgcgggcgcgctgttctctgccatgggatgtctccggtcatctgcgggatggcgtggtgccgcgcatctgcggcgtcagaatcagatgggcacgggcgatcgcccggcggtgccaggcaatcgcctcgtccagcgtcagggcggacagctcggatggctgccagccgaagatcagcgcgaggtcggctgcgaggtcgtcggggtcgacccggagccgctgccgaaaaaacccagcagacccacgcagagccgggtgaagtcggcgggatcgagcccatcgaccacggcggggtccagcaccggcgtcgaggtgcgcgagatcagctcggccacggcgcccacctccatctggtagacgtcgagcagcttcacgccgcgcagctggccgatccgcggccgggtcagcacgatctggtcggtgggcacgccgtcgacggtgacgggcgtgtcgaggcggatggtcacggtgtcggtcatggcggaagatcctgacgtggagaaaggggggggggagggaaggcggggccggcgatctgcggccccgccttccggtccggatcagacgccgagcgccgtgcgcagatcggacatctggtcgataccgccaatgcggcggaccatgttgagcgcgtcgatttccaccagctcccgtccgccgatggtcagccggtaatagctgagggccgcggtgtaggtggtggcggcgctttcacccggcgtccagtcgccgggatcgacggccttccagcggccgcgcatgtcgaccacgatggtttcggcctcggtaccgtccgaggccgcaccacgggcggtgatgccgatctcggcgccgaacaggccgaaatgctcgatcatggtcgcggacagctcggccagttcgaaactggcttccagcttttcgagccccatgtcgatctcgaccggcagatccatgccgccggcacggaaatcttcggtcttgaccgtcagcttgggcagggtgagcttggtcgcgcggccgagatacccccggccgtcgacataaagcgcgcaggcgcgcaggatcttgggcagcgttgccacggaaaatcgcctctctgttcagggcggatcgggaaggtggaatggccgcccgccgcgcgggagccgccgcacggcggggcaggctttccactcagacggcgagcgcttcggtccagtactcggcgttgcgatgggcgcggaaggtcaggcgctccagcggtgccggcggctcgatgtcgaaatcgacatagagcttgcccgcctgaagggtggccggcgtgttcaggtccgggtccagccaggccttgccgccgacgatggcgcccagcgcgatcagctcgcgcagataggcgttcacgctgccttcgatatcggcgaagagctggcgcgacagcggccggtccatcgcccagagcagggcgcgttcgatgctgtcatagatcaggtccgcggtacggcgcaccggcaggaactgccagagcggatcctgcgccgtggtgcggttgccccacaggcggaagccgttgttgcggatgatcgtggcgatcttcgcttcgttcagcaggttggattccgaattcgaatccgacagcgcgaaatcgaccgggcgcgagatgccgacgatgccggcgatctcgtgattgctgggcgaccaccagaagccacgctcgttgtcgatccgggcgatcagcccggcaacgcgggcagaggcgggctctgccacggcagcatcggtttcctgcgaccagaccatgaccttggggtcgacgacgaacaggcggtcggagccgagcgactggccataggtcagggcggcggccgtggtggtggccgggccgtcggcgatcaccaccgcccgcatcgacggcgcgaccgacagcagggccgcgaccaccgggttggcgggtgtgccgccatcggtgccctgatgggtgaagccggtggcgatcaggatgcgcggcgaggcgccgagtacggcctgtgccgccttcagcgcgtgcacgccggtgccgtcgaggctgctgccggcgacattgcccagcgtgtcggcctcgtcggtgccttcggtgacgcggatcaccgcgaccacggcgccggcctggtcatagatgccggccagtgccttgggcaggctgccgctgtcgcccaggccggcgagctggcggcgattggtcaccagcacgggcgtgtcgagcggccagtcggcggcgaccgcgtcgggtgcggtgccgatcaggccgatcaccgaggagcggacggtctggatcggccggatgccgtcgtcgacctcaagcacctcgatgccatggaggaaatcggtggccatggatcagtatcccctgagtgcggtgcgcgccgcggtcacggcggcctcgatcgcggtggcatcgtccagcaggtccagaccctgcttggccgagacgcggatggcctcgatattggcggcggcagcgatccaggcggtgcgggcggccaggatctcgtcggccagcgcggccacggtcatggcgcgggcctgggcctcggccgtcagcatcggccaggccgaggcgtcggccggccggccggccgcgacgaaggccgcggcggcttccgccttcatctggtaaatgccgtcctggccggcgagcgggctggcatggcggccacgggcggcaaccgcagccgcgtcgatcgcgcgccggccctgttcgcgggcatcctgaagcgcggctgcggcataaaccccggctggcaggcccagcatggccgcagcatcggcatcggtcacgccggcatagcggcgcccgtcatagatgatatccataggggaagcctcagagttcggtggaggagaggacgttgtagacgcggccggttgcatcggtcttcagaccggccatgaggtcgctataggtcaggccttcgggcaggacgttgttcgatgcgccgaagatcgccggctgctgtgcggcattgagcagcacgccccgcccggcagtgctgcgggtgatggtgctgccgtagatctgcagccacatgctggcggtgccggagctgcggttaacgaacgacgtcgtgccgagcgtgatgtcgcagaacagcaccccgaccagggcccccatcatatcgatgcggcggaccaggccatcggacggcaccgtctccagatcggcgggggtcgccgtttccaacgcgcagtagacgaaggagaccgatgcatcctgaacatagaagccatagacttcgttctcatctgcgctgagccgctgacggatgatcggcctgttgccggtcgtcaggttggcctgagaacggaactggatcgtcttcctgcgcagatagatgtccgcatcgatatcgtaaacatgcggcgcagccgccagatagatgatcccgtgaccacccaccggcacggcatcacaggcggctttaagagtgcggaagggctggctgctgctggtcccggaattggtgtcggcaccggttgcggcattcagatagtaggtcttcgaattgttcgggatcgcgttcagcgcattggcgaccgactggtcgatcgtctgcgccttggtgcgataggtctcgtagagcgagtcgactttgcccgtcagggcggcgatctcggtttcgagggcggtgaaggccatcgatcaggctccttcggcaaagcgggccattgcctcgatataggcaggcgacccttcgtggtagacggggtggacggggtagcgggtgcggatcagggtggtgccgccaccgtccttcgacacaggtggcaggaagacccggacaccgctggcacggaccgcgcgggtggtaccgtcggcatccagggcgaagcgtgcgccggcgctggtgtcggcgtcgtcgcccgcggtttcgccctggaacaggctatcgggcgtgaaccagttgacgctggcggcacgatagccgttgtagggggaagcctcggtgccggcaccggtgatggtggtctgttcggggatgccgtaggggttccagctctccagcggcgtgcgcaggatcaactccagcgggatcgcccagctcgcccgataggtgcggccgtcgcgctcgaagcccgagacgcgttcctgcgtggtcagggcggcccagagggtgggatcgttgaagccgcggtggaaaccggtgcgccctgacgcatccggcacgctcaggctggcacgccggctgtaataggcggcgttcagcgtggtgccggcgctccagccggtgatctgcttccactcactgtcttcgaaatactcttccagcaggctggcgccggcaccatcgagccccggaatcttctccatccaggtgtcgggggtcttcagcgcgaaacgggcatagcggcttccctccacatccgccggcacttcgctgcgcatccgggtcggcacatcgtcgacgaaggcgaccatgtccgaaatcttgtgatccttcagcgtcgagacggtgcgggtcaggatgcggtagcgcagcacagcgatctgaggccggccgcggatcgaccgcacggccaccggcacgaacgggttgttctcggcccgcagcttggcaccggtggtgtcgatcatctggatggtgttcagcagccccgccgccgaggtatcgtcggcctggtgacgcggggaatagaacgagtccgccacgccgccactctcgggcagcacctcccaccagacctcggcataggccaggtcccagcggaaatgctgggcgtcggcatcggcgatgctgccatcggtcaccttgtgcagcaggttgcgcatcttggtgatctgttcggcaggcgtacccgtcaccgacgccggcaccgtcaccggatcctggcgacgcaccgccagatagccgctgcctttcgcagccggcgtgttgtcgacatagtcgttatggcgggtgcgcaggtaccagccgttgaccaccatgccgagttccgcgaggcccatcacgcccgccagattggcgtgatcatgggcgttcagcgccgcatagccgatcgtggtcggccggtaccagggctcttcgccgcggctgcggatgttgtactggcgggtgacgatgatgccggactggccgttggcgcgcagcacttcggcctgcgattcggcggccgatgcggccgagagcgccaggctcgccgccagtcgttcggtcgatgcgacccgctcgccgacctgccgctccagcagcagacggtactgttcggtttcctggccgataaggcgcagctgctccttgatgtcgcggatctcggcatcccgctccagcccccgccggccctcgtcggtgaaggcggcgctgagtgccgtggcggcggtggcgctttcggcgatcgccggctcgatggcaaggtccagcggctggccctgatcgacgatctcgatcgcgcccagtggcacgtcggtgaccgtcagcgtcaggccgagcaggaagcgcaccggcgcggtcttgtagccgagcgcgccggaactcatcgaccagagccagaccagcgtgccgtcttcggcgaagaagccgacctcgcggatccagtattcgccgtcgtcgacgatcgccgcagacagcgccagctggtgattctgcgggtcgacctcggcatgggcgatctcgacccgcgctttttcagaggtgagggcggtggcggatgcaagcggcgtgtagccggcatcgcccaccgcgacatgggtgatcttcagtttcagaccggccgtgtcggcgtcgagaatcgcctgctggccggcggtcgtggtaacgacctggagattggtggtcatgaacgtcctctcgtcaggatgcggccgccatggcggtggcaagcaccaccgggcgccggaggatcgcggcgggatacaggtgcaggtcgacctgtgcttcgatgtcggccaaggggacctccgatcgggtgtgggccagggctgccgggcgggtgagggcggcaccgatccgatgcaccggccccgccgcggcagagagatggcggaagggcacggcggccgttccgtgggtgaggcttgccggccgtgtgagccgggcggcgaccgcctggccgacccgcaccgatccccggggctccggggtggcggacaggtcgtgcgacaccagcgtcgagcggcgcatggcgccgccgatttgcggtccggcgccgaaatcggcgccgatgcgcaggtcgaaatgcacccgggccggtgccgtgcgttgcaggatttcggtcagatcgcgcgccagatcgtctatcgtccagtcggggccgcgatcggcgtagtcgttggcataggcatcgaccagcaccgtgtagggcgccccctctactcccggatcgaaccattctctgagcgagatccgggtcttgagggcgctgagcgcggtgtggacggcggccggggtgccgcgggtggcgcgggtcttcagcatgctgcggatgacgttgcgcttgacctcggccggccagcccgggcgccagtaatcgacccccaccgcccaggcgagccacggcagccggtcctcggggcaggcatccacatcccaaagcggctcgatcggcaccggcacatcgccgatgcgggcgaaaccctcgtccagccgccgctccaggcgggtggcgttgggcggcatcaggcccttgaagccgtcactcatcgcccaccgtcccgccatcggccggatcggtgtccagcgtcacctcgatcgcctcgcaccaggcggcctcgtgggcctcgggcagcagatcgcctgccggttccagcaggcggacccgttccaccccgccctgatgcagggcctgcatcaggcccgaaatcgcgaccggcgtacccagcatccggcgggcctcgacatagcgggcgaccgatgcggtgccgtcggccatgatcacctcggcatcgggcaggctggtgatggtcagctttgccaccacccggtagggcagaatgcttgcggcggcgacgctcacccggtcggtcagcggccggacggtccggtcgttggcggcgtcgagcacggcatcgagcagggcggtcagccgtgcctgatcttcaggcgtgcccgacggtcgccattccggcagcacggtcaccaccacatctccgggtgccggagaggtcgcgatcgcatcgcggatatcgaccgacacatccagtgcccgggcacgataggccgcggcggggccggccaccgaccagccgtcgggcgtggtcagcacgcggctgcgcaggcggtcgtcggtttcatcggcaatccgcgacacgccgtaaagcgccgccagatgatccagatcggtgccggtcgcataggccagcatcacgctctgtgctgcatcgttcacccgctggcgcagcagaagctcgcgataggccaccacctccaccagcttgcgcagaggctcgctttccagctgcaaggcgccctccagcgaggggcttttttccacgaggtcggcgatgatctcgtcgcggatggcctcggcggtcagggtttccaccacatccggccggggcaggcgcgacaggttgagcggcgcgtcggtcacaggatcagtccttcaagaaccagggggcggccgtcggggcggtagacggcgtcgatggcgatctccagccggccggtggcagcgtcggccgcgaccagccggacccggtcgatccggatccgcggctcccagcgcgccagcgcatcggcggtttctgccgccacatcagcggcgagcgccgcacccagcggccggtcgatcagcgccggcaggtcggatccgtaatcccgcaccagcacgcggctgcccttgggtgtggtcaggatgtcgcggatcgactggcggacatggtccagcccgccgagtggccggccggtggcgcgcgaactgccaccgatgccgccgtcggcgacggcggtcgcgaatgtggtcagggtcatggcggtcagtctccgatcaggatccgggcctcgccctcggcaacccggctgccgcacgagaccggatcgtcgatccggccgatcgcgcggccgccgaccgtcagacgcggcgcaccggctgcaagcacgccgccatgggtttcgggaatggcggggcaggtatgggcggcgaaggcatggccgaccaggacgaccggccggccgcccacggtcagccgcgtctcgccttcgatcgacgggcggcccggccagcagccatggccggtgcaggcatcgcctttcagcgtcacgggcggcatggggtcagcctccttccagaagccggatcgcctgggcgtcgacatgaatggtgccgccggcccggatcaccagatccccgggaaggtcgatcaccacccgtttcgccgcccggtcgaccgtgacactcgacccgtcgccatggacggtgcggtggatatcggccgaggctgccggtgccggtgcgccggtcgaataaagcgcgggcaggatcacccccagccccggctcgccttcaggacagagcagcaccacggcctcgccgggttccggtgcccaccagctgcgatcaccgccggcgcgggtggtgatccagggcagccaggcggtcaaaagctcacccgaccggacgcgggcgcgggcattggcggggtcggtctcggcgatcaccccgcggcggagcaggttgacgagccggcgttccagctcgctcactcggaaagcgagatccgggctcatggctggcctccgcctgcatccggatcgtccaggccggtcaccggcacgtagtccgcgacgtgatcggggccgatccgcggagcgaagcccgccagaatctccgtcggcaatgggtcgaccggctcggccggtgcctcgcccagcaccacctcctgcagccattcgacccgccagaggcagatggctggatccgcagccgggggcgtgtacagaccggcggcaacgtcatgcggggcaccgggtgccggctcgtcgtcttccgcaacaccggccggatcggccagcggggcggcgagcggcaggcggcccgtgaccgcttcgaccagatccagcgcagcccgatcgcgatcgccggcgtcgtcatgccgggtggcgatccaggcggccagagccgcagcatggagatgacggccgtcatccatcatccggccgcggccgaggccggtgacgatcaccgtcaccagtgcctcggtgccggccggctccgcgccgatcagcgcggctgcgaccgcggcatccacggcaccgggatgggaccggcagacggcagcctcggggagccaggcggcgatcagcccggtcatccggtcgcgcagcatctgaagacgtcgggtggacatgtggggccgttcctcgtcgaaggagccgggacaccggtcttccggtgccccgctttgcccggcggaccggccggatacgcggccggcctgccggggtgacgagggggatgatggcccggaaccggcgccgggcatgcgctgtaccggttcaggtgaaatgcgaccgcatggcgctgccggtgatcaggccccggcgcgccgtgcggcccgaacggccgcccggcaggcatagacccagcgttcggtcacgccgaagcggcgcgccaccgcatgcgccgggcctgcggcgtcgccgatcaggcggcggcgatcggcccggtttgtcgggtggcgcggcagggtcagatggccgggaccgaaggcgtcgcagaaccgggtcgcggcctcgggcccgatcagggccgacagccagtggcccccggtccaggcgcccggcggacggaatgtagcggcgggtgccgccatagctgccgatcagcagatctgtggcctcggcaccgataagcgctgcgatgcgggctgcgcctggctgggtggtctcgggttccgtgatcatgtccgtgctccggttttgtcgtcaggttcacgggatgcggcatagcagaggccggagcggcgtctctacatacccggtgctgcaactgccggccggtttgcggccgcaaacgaaaaccccgccatccgattggatggcgggggtctgagatcgtccgacggtcccctgtcggggcggcgggatcagctgtggtaggcggcctcgccgtggctggacaggtccaggccctcgctctcggcttccttgctgacgcgcagaccgacgatcaggtcgacgatcttgtagaggatcaggctgccgatgcccgaccaggcgatggtgaccagcacggccaggatctgggtccagacctggtcggccatggtcacgccgtcggcatagccgatgccgccgagcgacgcgctggtgaacacgccggtgccgactgcgccgatgatgccgccgatgccgtgcacgccgaacacgtccaggctgtcgtcatagcccagcttgttcttcaccacggtcacgaagaagtagcagatcgccgaggcgatgatgccgagcacgatcgcgcccaccgggccgatcaggccggcggccggggtgacggcgaccaggccggcgacgatgcccgaggcggcgcccagcatcgaggccttgccgcgggcgaggctttcgatcaccacccaggcgaccagcgcgccggcagtggcggtgaaggtgttgatcatggcaagggcggcaccgccggtggcttccaggttggaaccggcgttgaagccgaaccagcccacccacaggatcgaagcaccgaccatggtcagcgtcatcgaatgcggggccatcatgtcacggccgagaccggtgcgcttgccgaccatgatgcagcctaccaggcccgcgatgccggcattgatgtgcacgaccgtgccgccggcgaaatccagcgcgccccaggcgaagagcatgccgtccgaatcccacaccatgtgggcgatcgggaagtagacgaaggtgacccacaggatgacgaacagcaccaccgccgtgaagcgcatgcgctcggcgaaggcgccgacgatcagtgccggggtgatgcaggcgaaggtcatctggaagcagatgaacacgtattccgggatcaccacgccgtcggtgaaggtggcggcgacgctgtccatggtgacgccggcgaggaaggccttgtcgagcccgccccagaacatgctgggggcatcgccgaaggccatcgaatagccccagagcgtccagacgatgatcaccacgccggtgatcatggtgcactgcatcagcaccgagagcatgttcttggcgcgcaccaggccgccatagaacagtgccagacccggcaggatcatgaagaggaccaggatggtggagaccatcatccaggcggtatcgcccttgtccatcgtcacggcggcctcggtggccgcctctgcggctgcgggtgccgcatcctgcgcccaggccggcagcgccgacaaggcgagggcgggcgccgcagcgagtagggttttcaggtgcttcattactatcccctggtcctcgaggaactgcatgactgcgaagcggtcgaaagtcggtcttcatcggcgggccggtgaggcccggacgcggccaccgccccataaggcaaacttcgcgccaatttccgaagtcacggaaaactcacccgaaaaaccctggtcggccacggcggtgcagcatggtgcacgctcattgaatgatcagacgcctaaaatgcaggcaattgtcacatatgggcagagacgcagatgccgccccgtccgggcggacggggcggcatgcagcgctgcttttgcgacgggtggacccgggcggtcagaccggccggtcggtccccttgatcgtggtccggtgcatgatccgccggtacttcacatcgtcatagggggtggccttgtgcatggtgcagcggttgtcccaaatcagcagatcgccctcctgccatttgtggcggtagacgaattcgtccgagatcgcatgagcgttgagcgtggcgagcagcgcggccgcctcgtccgccggcaggtccaggatctccttcacgatatcctcgcccacatagagcgacagccggccggtctcgggatgggtgcgcaccaccgggtgcacgacatccggggtggcggcgcgctgggcatcggtcagcggctcgcgatcgccgaaggccttgtcgtaatagccggcataggaatgcaccgccttcagatggcggatcttcgcctgcatctcggggtcgagcgcctcccaggcggcatgcatcgacgagaacagggtgtcagcaccttccggcgggcattcgcgggcgtagagcacggatccgaagcaggggatctccagataggaccagtcggagtgccagttccagccctccttgtggttgccgatcgagcggccggcttccttgacgttcgacaacacatagatttcgggatgcgccgtcgtcaggtactgggtcagcacgtggatctgcagatcgccgaaatggcgcgagaaggcgatgtgctgggcctcggtcaggttctggccgcgcagcagcagcaccgaatgcgtgttcagcaggtcgcgcatctccgcgaccatggcatcggaaatcggcgccgaggcgtcgacgcccaggatctcgacgccgatcacgggcgagagttccttgatctccatgagactgatccttccgtgcagacgtgggggaattgtcggtggtctctgatccgcgtagccaggggccacgacgtcagtcggcgtagccgggggcgacgtctctgagcaggcgcaggaaacccggccattcgcgaaagccagggcgtttgatgtcgccggcgaattcggtgaactggcgggcggccttttccgagacctcgggcggcggcagggccagactgccgccggatgccgccgcggccgcctgggccttcagctggatccgggccgcgcgctcgaagtaataggccagcatgaaggcctcggggatcgtctggccgacggtcaggaaaccgtgattgcgcagcagcagcacccggtgctggccgatatcggccaccagccggtcctgttcctccagatccagcgccacgccttcgtaggggtggatgccgatccggttgtggaaatgcatcgcgaactggctgaccggcagcagcccctcgggcagggccgaaaccgcggttgccgcgtccgaatgcagatgcagcacacagatcgcatcggcgcgggcacggtggatggcggcatggatcacgaacccggcccggttgacctcgcctgcgccattgcacagcttgttgccctcaagatcgatcttgagcagcgagcttgccgtgatctcgcggaagaacatgccataggggttgatcaggaagtggtgatcgctccccggcacccgggcggagatgtggttgtagatcaggtcgtccatgccgaaatgggcgacgaggcgatagcaggcggccagctgacggcgcagctcgtcttcggtcgcgggatggtcggagacggacatcatgtcctcgttttcaggaaatcactgccaccagaccagcttgcggtcgacccagaccagcagcaggtacaggatcatgctggcgaccgatgcggtgagcacgccggcccagaccagcaggaaatcgacctgctgggtggcctggaagatcacccagccgataccggcataggcgccgagcatttcagacacgatcgcgatcagcaccgcacggaccaccgcgacccggagcccgttcaccaccgagggcagggccgccggcacccgcagcttggccatgatggtgatcgggccggcgccgaagctgcgcatcaggttgatcgccgcctcttcgggccgcttcagcccgtgcagcgtgttgaccaggatcacgaaacccacggcgagcgtgaccatggcgatcttggaagccgggccgatccccagccagatcagcgcgagcggggtataggccaccaccggtaccgaattgatcgcgaccacaaccggcatcaatccgcgttcgaccgccggcaggaagaccatcagcatggccagcgccacaccgatggcagtgccgagcgcgtagccgaggcccgcttcataaagcgtcgcctgcagggcggtcagcatcatcggcaggtcgtcgatggtggcgccgaagatggcggtgagcgagggcagcacatagggcttcacgtcgaaggcccatatggcggcctcccagatgccgccgatgaccgccaggcccaggaccaccggcaggacccgctcgcgcagaaccgcgccgatgttcaatcctgccgccaccatatgaacttcctttcgaacagggagaccacggtatagagggcggagcccagcaggccgcaggcaaggatgatcgcccagagccgcggcacggcttcggtgtacatcgcctggatcagcatcacgcccagccccaccgtgtcgccgaaccattcgcccacgatcgcgccgatcaggctgagcgagatgccgagccggagcgccaccgcgatcaccggcagggcggtggggaagcgcagcttgcggaagatggtccactcgccggcaccgaagctcttcatcagcgccaccttctgcgggtcgcagcccagcaggccgcgatgcgtgttcacggtgacggggaagaaggttacgtagaaggcgatgatcaccttcgacaggatggtattgccgaaccagatgatcaccagcgcgccgaaggcgatgaccgggatggtctgcgacaccacgaacagcggaaaaagcgcccgttccagattgcgggaataggcgaagaccacgccgcagaagatgccgaaggccgatccggtcaggaagcccagcacggtttcaaggaaggtgcggccggtgctgcgcagcagataggaccagaccgaggcggcatcggccagcaccaccgacagcggcgggaagaacgaggccggcacctcgaagatccgggtgatgccttcccagaggatggcgagggtgatgatggtcagcagcggcagtcgcaccgcctgccagacccgtgccgccggcccgccggatgcccgggcggcactcatcccgcacccccggtcgtggagacgaagctcttgcgggcttcctcctcgatcgcgcccagcaggcggcgcttgatctcgatgaattcgggcgaggtcacgataccggcatcgcgcggacgtggcagctcgatcacctcgtcgcatttgatcgtgccgggacgcgacgtcatcaccaccacccggtcgcccaggaagatcgcctcgtcgatgtcgtgggtgatgaacagcaccgtacggcgatagcgcgcccagatgtcgagcagccagcgctgcatcatcgcccgggtcagcgcatccagcgcgccgaagggttcgtcgagcaggatcatgtcgcgctcgaacaggaaggtgcgcatcagcgccacccgctggcgcatgccgcccgacagctggtgcggatagtgcttctcaaagcccttcaggccgaaatccggcagcatctccagcgccctggcgcgggcggcggccttgggcgtgccctccacctccagccccaggatggcgttgtcgaccacattgcgccaggcgaacagaagatcgcgctgcggcatgaacgacaccttgccgagcagggcgccatcggccatcggccggccatgcatcaggatcgagccgtcatcgtcggccggcagcagcccgcccaccatgttgaacagggtggatttgccgcagcccgaggggccgaccagacagacgaactcgccctcgcggatcttcaggttgacgttcgagactgcggtcacctgcgccgggccgtcgccgaaccgcttccacagattgaccagttcgagcaggggcggcttctcccccgccacggccggggccgtggcggcagaggagacggaagacgacgagggcgccatcgcggtgctggtggaggaggggggcatcatccgcctttccgctctcagagcttcttgtcttcggccgggaccttgtcccagaaggagggatcgaacgcggccttcagatcgaccggagccttcatcacgccattggcgagcaggatgtcgtgctgcttctgcaggctgtcgaaatcgatcgcgagcaggccgtcgctggcgcccttgccatagaccatcacgtcctggatggcctcgatcatggcttcctgatgcttgcgatccatgccgggatcggccttcatcatgatgtcgatcgcctcggccttgtgctcgagcgcatatttccagcccttgagcgtggcggtgagaaagccctgtaccagctccggcttgtccttgacggtgtcggtggtggtgaccagcgtgtcgcgctgcacggtgatgccgaaatcatcgggctggaacagcaccagatcggtcaggccgcgcgacttcagcgtgttcagctcgttgtagagcgttgcggtcgcgacatcgacctcgccgtcgatgaacgggttcagcgacaccgactgcggcatcagggtgaaatcgccctcgccgacgccgccggtcgccaacatcgccttcagcgtgtactgcgcgccggtgtaccaggtggagaccttcttgcccttgaagtcggcgagcgtcttgatgccgctgtcgggcttggtgacgaaggcatagggcgtcttctgatgcgaaacgccgatcgcgaccaggggcatgcccttgtccaccgccgccagatggctttccacgccgccggtcaggccgaaagtatcggcgcccgaagcgaccagcgcttcggcgttcaggttcgggccgcctggattgatggtcaggtcgatgccctcggcttcgtagaagcccttggccttcgcgacgtagaagccggcgaactgcgcctggggcagccatttcagccggagcgaggctttctctgccgcccgggcatcctgggcgccgcccagggtcgcggccgccagcagcggtgccgcaagcgcaagggcgacggcggcccggcgggcgcctttcgcgaagaggggtgcgaaagccatgtcgtctggtctcctcgatcgtcgggggccgttgaaggcgtggcggcggtgatgtcgaccatgggcctgcggtccgggttgcggaacctggctgcatgccatgtcatgcgggtgctgcctttgcggcaccctgccggagcgttgcaacggccgtgccagacgcggcagcgtgtgacggagagatgacggttctgcccgcaatcggccgcagaccgccgtgcaccggccgcgtgcacgaatgcgcggcacagcattcttgtatgcaagaaagccaaaggccgcataaaatttggccaatttcggatatgtgtgcccaaattttccgcacggaagcccgaatgctcatgaaaaaggcatggatgccctggtgcgatctggacagattgcgcggttctcgatacaaaaaatgcagatctgcatgcaggagatggcgacatggtcgacgtaccgcccgccgccggcagcccggggctgcccttcacgcccgacgaacgggcggattatcgcagcatccgcgaaagccaggcccgggattacgaaatccaggagcgccacatggcgcgtcatcgccagggcacgccggatctgtatctgcggctgctggcggggttggcgaccccgcatctcggcttcccgatcgaccggctggaacattccctgcaaacggcaagccgggccctgcgcgacggccgggacgaactttatgtcttcgcggcgctgttccatgatgtcggcgatgccgttgcacccgccaatcatcccgaggccggggcggcgatgctgcgcccctatgtctccgacgatctttactggatggtccgccatcacggcagcttccagggttattactactggcacttcctgggccgcgaccgcgacgcgcgggagaaataccgggatcatcgcctgttcggcttcaccgccgagttctgcgaactctatgatcaggcggccttcgatcgggactaccggtcattgagcctggcggatttcgagccactggtgcgggaggtgatgtctcggccgcggaatttcgtccccgactaatgcagagggcctgtgcgtatgctcatccggcggttctgcgtgcatggtgacgataaaaccgctattgtccgcggggcggtatcgctccgccgtctccgttgagcggatccgcgcccccatgaagatggtgtcatgaagatcaagacggtgcccgtggtgaccgaaacccgtgccgaaagcctgcgccgcagcctggaacagcagatcgtccgtggcgagctgcgccccggcgaccggctggacgaggtggaactggccgagcgcttcaacgtgtcgcggaccccggtgcgcgaggccctgcatgcgctggccgcggccgggctgatcgagatgcgctcccgccagggggcgacggtgtccaccgtgtcgatctcgatgctgctggagatgttccagatcatggccgagctggaaggcctctgcgccagctttgccgcccgccgcgccaatgccgcccagcgccgcaaccttcaggccatccatgaacgcctggtccgggtgatccaggacgacgagcccgaggccttctacgaggtcaaccgggaattccacgaggcgatctacgatgcctcgaattccgaattcatcgccgaacagacgctggcgctgcgcaaccgcgtgtcgccctatcgccgctatgtcaccttcctgcctggccggatgaccgcaacgctggacgagcacgagcgggtgctgaacgcgatcctcgccgccgattccgccggcgcccaggcggcgatgcgcgatcatgtcaccctgctgggcgacaatctgaccgacttcatcgccgccatcccgccgagcgtgctcaaaaccgcctgagcccctggccaggcgttccggcgattatttcacgccgacatgccgttcggccgggacacgagcggtccggaattcgtaggtgatctcgtcgccttcggccgacaggatacgcagttcggcacgatcgcccgactgccgctcgcaccagctgcccggcgacgcctggcgggcctgatagctgcgggtgccagcctggctgccgacatagtcgaaatcgatcgtgcagttccgcggcgctccgaaggccaggcgcaggcggttcttcgcctccccgcctcacccggcaccagcagcatcaccgcctgcggccggtcattgatcatgaagaccgagtgatagcggccagcggtctcttccgccgcctgcgccggcatggcggccaatccgagaagcagggccagggtggtgcgtgtcatgagtgacatccgtcgggctttcgatcgagggtgacgatcttcgcatcatagatgcaattttcaggtcatgtgcgccgatctgccctgatccatccgcaggccggtataggggcgtgcgaattccccttttcatcgccccgccccggtcacatgatggccaatgtgtagtgacctgcggagcatcggcgtgtccgtccggggcgtcatcttgagccttctggtcgtgctgctctgcgtggtcgggcggcatgggtttgctgttgaggcagaaccggccgccgggcggccggttctggatccggcgcagcaggcctggcttgccgcttacggtccggtcacctttggggtggtggaggccggctggccgccctatgacagcgtcaccgccgacggcagctgggaggggatgagcgccgattacgtggccgccatcgcccgggctgtgggcgcccggatccgcgaggtccgctttcccgactggaacgctgcgatcgctgccctgagcgccgggcagatcgacgccctggccagcatgaaccgcacgcctgcgcgtgaagcggcgatgagcttcaccaccgcctatgtcaccagccgggcggtgatcgtctctccgcgcgaccgcctgccgccgacatccctggacgacctggcgggcgagaccgtcgccatggaacgcggctatgccaccaccgagcatctcgccgccggctatcccgccatccggctcgccctggtcgccgataccgccgcggcgcttgacatggtcgcctcgggccaggccgccgcctatgtcggcgaaatggcggccgcgagctggatcatccgccaccgccggctggacgggctgcagatcggcgccgtgaccgatctcaacaccggcgcgctgtccatcgccgtcacccgcaatctgccgccgctgaccgggattctgtccgccggcatccgcgcattgacgcccgaacagcaccgcgagatccgcggccggtggctgtcttcggtggccgtcggcatgctggatgtagcacggccgcgccttgatgatcgtcaggccgactggatcgcgcgccaccgggtgctgacggtcgcggccacccgcagtaccgcaccgctcggtttcatcgaccgcaatggccaccatgccggcatcgccgccgatgtgctcgaccacatcgccaccgccaccggtttcaccattaatctggtgccggctgacagcccggccgaggcgcgccgtctgctgtatgaaggccgggtcgatgcggtggcgagcctcggtcatctgcgcgaggtggaagacggcatcgtctttccggtcgcccatgcccgcaccccctgggtgctggtcgaccggatcgacaccaagccgatccaggcggcgggtgacctgttcgggcggcgggtcgcggtggtcgacggcagtgcggtcgcggcggcggtgaagggtatcgcaccggggctggtggtcacccgctggccgacggccgaggcggcgctcaaggccgtcgccggcggtgccgccgatgtggccgcggcagagcttgcggtggccagctgggaaatccgccggcttggcctgggcaatctgaagctgaccggtctgccaggcggcaatgatgtcgtcttcggcctggcggtcctggccgacagccacatgctggccggcatcctgcgggtggcgggtgccgatctcgacaccggcacgctcaacgctatcaccgcccgctggcaggaggggcggttcgaacagcggctcgacctgtctgtcgtgctgccctggatcctgccgccggccgcggcgatcctggcggcgcttgcgatcttcggcatctggaaccggcgcctgaaggcagaggtcgccgagcgggcgcgcgcggaagaagacagtgccgaagcgacggcccggcttcggatgatcctggatctgctgcccggcgccgtctatctcatcgggcccgacggccggctgcgcttcgtcaaccccggtttcgccagcctgttcggtgtgccggcagacatcgctcagcccggcatggcgatgatggacgtcgtccgccgcttcgcgaccgaaggcgtctacgggccgaccgacgatcctgaggccgtcgcgcgccggcgctgggatgcctttctgggcgcccccagcaccggcacgcttgccactttcctcaccctgcccgacgggcgttcggtcaatgtggtgcgctcaccctccaccgccgacggggtgctgtgtgtcgcaaccgacgtcaccgaccgggtgcgcgcggaacgggcgctggaggcgagcgaggcgacgctccgcggcatcatcgcctcggccttcgatgccatcgtgatgatcgatgcccgcgaacatgttctgttgtggaacccggcggccgaacagctcttcggctatgctgcggccgatacggtggggcgcaatgtccacgacctgatcacgcccgaccgccaccgggcggtgctgagggcgggggctgcccgtgccatggccgatgccggcgacaccccctggacgcgcacccgcgagatcgaggcgcggcgcgccgacggcaccgaattcccggtggaattcagcctctcgaccttcaggctgcacggtgcctggcatggcgtggtcttcgtgcgcgacatcaccccgcgccggcatgcggccgacgagctggcccgcgcccgcgatctggccgagcaggccagccggttgaagagcgatttcctcgccaatatgagccatgaaatccgcaccccgatgaatgccgtgatcggcatgacccatctggcgctcaagaccgaactcaccccccgccagcgcgactatctgcagaagatccagggggcggccgacgggctgctcggcatcatcaacgacatcctcgacttctcgaagatcgagaacggccggctggagctggaggcggtggatttccgcctcgacgacgtgctcggcaatcttgcgaccgtgatcggccatcgcgcggaagagaagcggctggaattcatcttcgacgttgcccccgacgtgcccggcacgcttctgggtgatccgctccgtctgggccaggtgctgatcaacctggccggcaatgcggtcaagttcaccgagaccggcgaggtggtggtctcggtccggctggtgatctccgatgccgatggccaccggctgcgcttcgcggtgcgcgacaccggcatcggcatgacgcccgaccagatgtcgcatctgttcgagcccttcacccaggccgacggctccatcacccggcgctatggcggcaccgggctcggcctcagcatcagccgccgcctggtccggatgatggatggcgaggtgacggttgagagcacgcccggtgccggcagtgtcttcaccttcgatgccgccttcggccgcagccgtgcccgctggtcgcggatcacggcacggccggatctgcgcggcctgcatgtgctggtgatcgacgacaacccgctcgcccgccaggtcttgaccggcatgctggagggcatggccttccgggtggtggcggtgccctcgggggaggcggggctggaagcgctcgcccgcggccgcgaggtggaggatccctatagcctggtcctgctcgactggcggctgggggccgggctcgacgggctcgccaccgccgggttgatcgcccaggcggcggccgaagcgggcgcgccggtgccgccgatcgtgatgatcaccgccttcgggcgcgacgatctgcgccagtcggccgaggcggcgggcatccgggcggtgctgggcaagcccttcaacgcctccaccctgttcgacaccatcatgcatgtcttcgacgacggcggcggtgatgatgtccgggcggcagccacccaggccctgcccgatctgcggggcgggcgggtgctgctggtagaggacaatgcccttaaccagcaggtggcgctggagctgctggaggccgcggggctggtggtcgatgtcgaaaccgacggtcgggcggcgctcgaccggctggtggcagggccgcgaccgccggtgcacgatctggtgctgatggatctgcagatgccggtgatggatggctacgaggcgacgcgggcgatccgggcgacgcccggcctggcgaatctgccgatcgtggcgatgaccgcccatgccctggccgaggaacgccagcgctgcctggaggcgggcatgaacgactgcgtcaccaagccggtcgatccggagcggctgatggcggtggtggcggggttcgtccgtcccggcggcgatctggcgggcctgctgccggtcctgccggcgccgtgcgatctggcggccctgccgccgcttgccggcattgaggtggaggcggccctgcgtcgcctggccggcaatgcccggctctatcgtgacctgctgttgcgcctgctggccgatcatgccgatgccgcgggccggatccgcaccgccctcgggtccggcgatgcggcagaggcgcggatgatcgcccatgccctggccggtgtggccggcaatctgggcatcacggccctcgccgccgccgcgggtggggtcgaggcggcgttgaagcatccggatggcgaccccgaggcggcggtcgcggcccttgaagcggccttcgatgccgcggccgaggtgatccggcccctggcggggctggaagactccgaaccggatccaccgccgccggccgatgccgccgccgtcgcccgggcacatgatgcgcttgcacggctggcggctctgctgcgcgacagcgacggcgccgccgtcgacctgttcgaggccgagcgcggcacgcttgtcgcgatcctgccccccgccatgctggcgacactgggcgggcggatcgatgccttcgattttgacggagccagtaccctgatcgccggcaccctgatcgccggggccatggaggcggacgaatgaccgaccgcaagaccattctgctggtggacgatacgccgtccaatctcaccattatcaacgcggtgctgaaggacgactaccgcacccgcatcgcgaccggcggcgccaaggcgctggagatcgccgccgggcccgagggccggcccgatctggtgctgatggacgtgatgatgccgggcatggatggctacgaggtctgccggcggctgaaggccgatccggccaccgccgacattccggttatcttcctgaccgcactccacgatgagcgcgacgagcgcgcgggcttcgcggcgggtggggtcgacttcatcaccaagccgttctcgcccgagatcgtgcgcgcccgggtgcgcacccatctggcgctcagggaagccaatgcccggcttgcgcgccagaatgccgagctggagcggcgggtggacgagcgcacccgcgaactggccctggtccgcgacctgaccatcttctcgctggcctcgctggccgaaacccgcgacaacgagaccggcaaccatatccgccgcacccagacctatgtccgcgaactggcactggccctcagggaccatccccgtttccgggccgaactcgacgatgccaccatcgacctgctctacaaatccgccccgctgcacgatatcggcaaggtcggcgtgcccgacgccatcctgctcaagcccggccggctgacgcccgaggaattcgaggtgatgaagcagcacgccgaattcggccgcgccgccatcgccgccgccgaggcccggatcggctcgggcaatggcaattccttcctccgctacgctcgcgagatcgcccacacccatcacgaaaaatgggacggcagcggctatccccgcggccttgccggcgatgccatcccgctctcaggcaggctgatggcggtggcggacgtctatgacgcgctgatctgcaagcggatctacaagcccgcctattcccacgagaccgccgtcgacatcatcacccagggccgcggcacccatttcgaccccgacatcgtcgacgccttcctgaccctcgccgaccgcttccgcgacatcgcggcggagtttgccgatccggaagaggcgtgacgcccatatcgggcgtcagcgccggcggcggagctgcatcacactcgccaccgccgcaaaccccgcgccaagaatggtgacggccatccacccgcccgcctgccaggccgctgtggctgtggcggaaccggtggcgccgcccaggaacatggcgcccatgaacagggtgttgatccgggcgcgggcttccggggcgagggcgaagatgacgtgctggttggagaccagggccgcctggacggcgaagtcgagcaggacgacgcccgcgatcatgccggcgaggctggtccaggcgccgaagatcgcccaggcggcgagggtgccgagggcgccggccaggatcacccggtcggggccgcggcggtcggcgatgcggccggcgaggggcgcggccagcacgccggccatgccgaccaggccgaaggcgccggcggcatccgcccccaggccgaagcgcggatcctgcaaccggaaggcgagcaccgtccagaacaccgagaaggcggcgaagagcagcgcctgggtcgccgccgcccggcgcagcgcgccatgcgcccgccagagcccggcgagagagcggagcgacgcagcccaggtcaggcccccggccggccgggccggggcatggggcaggcgccaggcgagcagggccgcggtgccgagcgccagcggcacgcccagccagaacatctcgcgccagccggcatggctgccgacgaaaccggccagcgtgcggctgagcaggatgccggcaagcagccccgacatcaccgtgccgaccaccgccccccggcgtgcgggcgccgccagatgggcggcgaagggcacgatctgctgggcgacggtggcggcaaggccgatcgcgaacgacgccgccaccagcagcagcgcatcgggcgccagcgccgccccgaccagagccagggcgagggccaggaactgcagggtgatcagccgccgccgctctaccagatcgcccagcggcaccagcaggaacagccccgcggcatagcccagctgggtggcggtgggcaccagcgcggtcgcggtgccgctgaggtcctgtccgatcaaccccagcaatggctggttgtaatagatattggcggcagcaataccggttgcggctgccatggtgaagctcaggccccggccgattccggtggccggggcggcctggccggccgtgccggctgcggttcctgcggtcatgatcgcctcgcatcttgttggccccgctaatctggcctaccctcaagatccgcggtaccggccgcgattgatcagcctgcctatcggaaaacgatatgattgacctgaacgacgtcgcggtgctggtggaggcggtggcggccggcagcctggcgggggcggcccgccggttgggcatcggcccgatggtcgcctcgcgccggctggcggcgctggaggacgaactcggcgtgcggctggtccaccgcaccacccgcgccctgtcgctcacgcccgagggcgaggccttctggccctatgcccagaccctgctggagaacgcgaccgatggccgcgctgccgtgcgcccggccgcgtcgggggcggcgggccggctgcgggtcacctgttcggtaccttttgcgcgcaaggtggtggcgccgatgatgggcggcttcctgcgcgacaatccggcgctggaggtggagctggtggcgagcgatgcggtcgtcgacatcgtggcccaggggctggatctcgcgatccgcatcgcgcccctgcgcgacagcaccctgatcgcgcggcgggtggcgcccaatccgcggcagctggttgcctcgcccgcctatttggccgcccgcggcacgccgtgccgggtggcggagcttgcggatcatgactgcctcactacacccggcaccggccactggtccttttcggggcccgcgggcccgcttcgccagcgggtgcgcggacgctttaccgccacttcgatcgatgccctgcaggaggcctgtatcgacgggctgggccttaccatcatcgccgactggaatgtccgcgacgacctcgcgaccggccgtcttcgggtcgtgacgcttgaagacggcgcgcccgagccgctgaccatctgggcgatccaccccaccacccgcttcgtgccgcccaaggtccgtctgttcgtggcggcgctggaggcgcatctcggcgcccgctgacggcgtgtcgcgccgctatccggcggtcagcgcctgccgcgccgcggcaaccgccgtgcctgtatcgccgcggaaatggaccgcgggcggggtcagcccatggcggtggagcatgtgacgcacggcggggcgggcagcggcgatccacaaggtggcgccctggcggtcggccttgcggcggaaaccgtcgatggtggcggcgccggtggaatcgagcaggggcaccgcgctcatatccagcacgtaagccttgggggccgcggcgccgacattgtcgagcgtggcgccgacggtcgctgcggcgccgaagaagaaggcgccggagatgcgcagcacggccaccgcgcgctcgtcgccttcggccggctgccaagcggtgcggccgccggtttcggggcggtcgctgtcggcgcggtcgggttcgatcagcggcacgccggtctccaccgccaccgtgccggccatgcggtgcaggaagatcagcgcgcccagcgagaagccggcgacgatgccggcggtcagatcctcgaacaccgtcagcaggaaggtgaccgccagcacggcggcgtccccgcgggaggcgcggagcaggatgccgatcgcgtggcgctcgatcatgttccacgacaccaccgccagcacgccggccagcgctgcgagcgggatataggctgcgagcggcgccgcgatcaccatgaagcccagcaggaacagggcatgcagcatgcccgagaccgggccgcgtgcgcccgagcggacattggtggccgtgcgggcgatggtgccggtcacgcagatgccgccgaacagggcggaggcgatgttggccacaccctgggcgaccagttcgcagttcgaccggtggcgccggccggtcatggcatcggccaccaccgccgagagcaggctttcgatcgagcccagcagcgcgaaggaaagggcggccggcagcacggccatgaccttctcgaccgagatcgccggcagggcgggggcgggcagcatggaggggatgccgccgaaccggctgccgatggtctcaaccggcaggccggcgagggcggcgaccagggcggtgccgaccacggcgatcagcatgcccggcaggcggggggcgaagcgtttggtgccctggatgatcaggatggcggccagggccagcgcgattgccgccgggctggcggtgcccgcggcatcggccagcgcgtgcagcttgggcaggatggcggcgggttcggggcccgccagatgcagccccgccagatccttgatctggcttgagaagatgatcaccgcgataccggcggtgaagcccaccgtcaccggataggggatgtatttgatgaaggtgccgagccggagtgccccgatcgcaagcaggatcaggccggagagcatcgttgccaggatcagcccgtcgacgccgtgggtcgcgacggtggatgccaccagcacgatgaaggcgccggccgggccgccgatctggaagcggctgccgccgagggcggagaccagaaaaccgccgatgatggcggtgtagaggccgcgttcgggcccaacgcccgaggcgatcgcgatcgccatcgacagcggcagggcgacgatggcgacggtcaggccggcgatcgcatcggcgcgcagtgcgcccaggccgtagccttcacgtagcacggtgaggagtttgggggtgaaaagctccgccaggcgcgggctctgggctgaggcggccatccgttccggatcccttggcatgatcggcccctcccccgtcgggggcgggcatgatctgggccggtggcggggacaggcggtcagcggccgggcggtgcctctttcaggcgcacgccgcgaccctggccgaggctctgggccccgtcgccgatcaattccacgcccgcccgatcgaaggcctcgatcaccttggtcagggtgtcgacgaccccgcgcaccgtcccttcgctcgcctccatccgctggatggtggggagcgacacaccggcaagctcggccagctgacgctggtcgatgccgagcagggcgcgggctgcgcgcatctgggccgccgtgatcaaggggtcctccggtccggactggcaatcctcatgttagtaccttcaaaaatgatgtccagaacatcagtatcggcgtttacagcatcaggacttgcatatgctgcatggctcggctgcgcatcatagccgctgcccggggctgcgtcaggcttgactcgcagtgtcatgtttgtactgttcgatacagaaattatcaaacggtacagatcatcggagatcgcccatgcgtccgcccatcccacccttcaccgccgaagccgccgccctgaaggtgcgcgccgccgaagacggctggaacagccgcgaccctgaacgggtcgccggcgcctatacgcccgactgcctgtggcgcaaccgggcgagtttcgtgcgcggccgcgcggagatcgtgaccttcctgaccgcgaaatggacccgcgaactcgactaccggctgatcaaggaactctgggccacggcaggggatcggatcgcggtgcgcttcgcctatgaatggcatgacgacagcggcaactggttccgctcctacggcaacgagaactgggagttcgacacggacgggctgatgaagcgccggatcgccagcatcaacgatctgccgatcgcggcggccgaccgcaaattcttctggcccctggggcggcggccggatgatcatccgggcctgagcgatctgggtctgtaagagaggggaggcggcgcgacgccatggcacggctggtcagggaacgcagcgacatcatcccgcttctgggcgaggtgttccgcgcccatggctatgagggggccagcttgcaggtgatcggcgccgccaccgggctcggccgcggcagcctgtacaatttcttccccggggggaaggaagagatggcggcggccgtgctggccgatatcgaccgctggttccgggacgagatcttccgggcccttgagaccgccgccgcctcgggcgatccccatcgcgcccgggcggcgatcgaggaaacggcggccgcggtcgggcggtatttccgcggcgggcggcggatctgcctggtcggcgccttcgcgctcgatggtgtgcgcgaccgtttcgcggcggcggtcgccagctatttccgggcctggatcgatgcccttgctgcggcgctggacacaatggggcttgcccccggcacggcgcgcgaccgggcggtcacggcggtcgccgacatccagggggccctggttctggcccgcgcgctcgacgatcccggcctgttcgaaacccggctcagggcgatcgtgaccgccctcaccgcagatccgaccggggcggattaggctcgggggctctggtcgcggcgcccctgcggtcatatatgtgggggcttgccgtcgtcccccgcgtgaacaggacccgcctctgatgtctccgatcgataccggccgcctgaacggccggtccccggccagccggatcatgcggtggttcgagtcccggctcgacccctatccgccggcggcgccgacccagccgccgcgcgggctggtcgccttctgccgccattacacccggggggcggaaccctggctgatcgccatggcgctgctctccaccgccatcgcgctggccgaggtggcgctgttctcgttcatgggctcgctggtcgatctgcttcaggcgaacacgcccgaggggctgttcgcggccgaaggctggaagctcatcggcatggcggtactggtgctggtggtgatgccggcgatcgcgctcggcaattcgctgatcatccaccagaccctgctcggcaatttcccgatgcgcatccgctggagcctgcaccgctatctggtgcgccagtcgatgagctatttccaggacgagttcgccggccgggtcgcgaccaagctgatgcagacctcgctcgcggtgcgcgagaccgtgatcaagctgctcgacatgggcaattacgtgctggtctacatgaccggcgccctgatcgtcgcggcctcggcggactggcggctgatgctgcccttccttgcctggatcctgctttatgccgcgctgctgcgctggttcattccgcgcatgcgcgcggtctctcaggcccaggccgatgcgcggtccgagatgaccgggcggatcgtcgacagctacaccaatatcgcgaccgtcaaactgttctcccatgcccgccgcgaggacggctatgcccgcgacgccatggagagtttcctcaagacggtgcatctgcagatgcggatgtcgaccgtggtccaggtcggcaatctgtgtctgaactatctgctgatcgcctcggtggcggcgctgggcatctggctctggacggtgcaggcggtcagcgtgggcgagattgcggtggcggtatcgttcacgctgcgtctgatgggcatgtcgcagtggatcatgtgggaaatggccgggctgttcgagaatatcggcacggtccaggacggcatgaactcgatctcgctgccctacgaggtggccgaccggccggatgcgcgcgcgcttggcccggtgacgggggccatccgtttcgatcacgtcggcttcaattacggcggccgccggccggtggtgcgcgatttcgacctggtggtgaaaccgggcgagaagatcgggctgatcggccggtccggtgccggcaagtcgacggtggtgaaccttctgctgcgcttctacgacgtcgaacagggccggatcaccatcgacggcaccgacatcgcgaccgtcacccaggattctctgcgggcggcgatcggcgtggtgacgcaggatacctccctgctgcatcgctcggtgcgcgacaacatcgtctatggccggcccgatgccggcgatgacgagatgatccgtgccgcccgccgggccgaggccgatgatttcatcgccaccctggtcgacagccatggccgccgcggctatgacgcccatgtgggtgagcgcggggtgaagctctcgggcggtcagcgccagcgcgtcgccatcgcccgggcgatgctcaaggacgcgccgatcctgatcctcgacgaggcgacggccgcgctcgattccgaagtcgaggcggcgatccaggccaatctcgaccggctgatggagggcaagaccgtgatcgccatcgcccatcgcctgtcgaccattgccgccatggaccggctggtggtgatggatcagggccgcatcgtcgaacagggcacccatgatcagctgatcgcggccggcggcctctatgcccggctgtggcatcgccagtcgggcggcttcatccaggccgatgacgagccggcagaggtgctgcagggggcctgacgccccctgtttctgcaaatcatgggagatcaaagccatatggccctgttgcgccgcctcgccgccctggccctgctggtggcggcggcgatcgggatcttccatgtcctggccgggatgcgggcagggaccgtccggcccggtctggtgctgatgaccggcctgctcgccatcggggtgcaggtggcggcccatcagctggtcatccacggccttgcccgcggcggccgcaggcgggccgccgtcgctgcggtctcggccttgctcgcgaccacgctgttcgcgggcggtgccggggtgctggccgatctgatgatcacccaccggcagatgatgatgaccggcaccggcggcgccatgctgaccgtggccgtgctgctgctctacaccgcctttctggtgctggcgagccatcggacggagcgggtggggcgggggcctgccatcctctccacccttccgatcctggcagtcctcggctgggccggctggcggatcgcctcaggcccgggtttcgccgccatccccgccatcctggccgacgggagcggcgccgaccggctcgcgttggcctgcgtcgccctgatgaccatcgggctggtggcgcagggggcacgccagctgctgaaacgacaggtcaccccggatctgccgtcagggcttccggcgccgtcctatcgcgatggcggagtttatgtgccggagtccgggtgggacgggagcggtgacggtggggatgggtcctgcgactgatggtgccgaacgagaagcgggggcggatgccgtgcacccgcccccgcccggccataccggagggacccgtgtttccggtatggctcacttcgtcttcgtcacgccccagaagcggtcgaaaccggccgaccagggggtgtaacccttgaggtcgggcgccgtggcgatgacgcggacgtcgttgtaaaggccgatcaccggcaccgcctcggccatgcggctgtggatgcggtcgaagatcttgccgcggaccgccggatccatggtctgcttggcggcttccagcagcttgatcgcgtccggatcgtcccagctggcgctgggctgttcggtcttgtcgccgatgatcgaggaataggcgagcgccggatccagccgcgaggaatagacgaaggactgcatctgatacttgccctgcagatagttctgcagctgcgtcgcccagtccagcacctcgatctgggcgttgatgcccgccgcctgcatcatcgcctgggcggtgaccgcggtttcgtgatagccgccggggcgcatattggtctggatgcggatcggctcgcccttatagccggcctctttcagcagcttctgcgcaagcgccggatcataggccggccactgatcatgggtggcgttgtgataggggctggcggtggcgacgccggacggattggcggtggcgacgccttcgctggcgaccgctacaaccgaaggcacgtcgattgcgtgcgcaatcgccttgcggatgcgggggtccttcagcaccggatcctggatctggatcagcagcaggtgccaggacaggatcggctgtttgtagatcgacaccccgcggctttcggcctccgggatctcggcggcgccgagttcgggcacgaaatccagctcgccggcataaagcgcgttcttcatcaccgtgccgtcgggcgcgatcaggaagcgcagatgatcggccagcgccggcttggcgccggtcatgccgtccgacgggccctcgcggccggtatagccgtcgaagcggtccagctcgacatagcggccgggcttccagtcgccgatcacataggggccggtgccgaccggcgccttccagctgccgtcttcattgaccgaggacgggtgcaggatggcggcgttgcactgcaggttcgacatgaacagcggcagcatcgggttcggcttttccagccggaacaccaccgcatagggctcgggcgtctcgatcgcggtgatcgcagcaccctgtttgccgtcgaagaagcgcttgcactgccaggcggtctccgccttcagatagcggttccagctccaggcgacatcggccgaggtcatctcggcgccgttctggaagtggacgcccttgcgcagctgaaagcgccaggacaggccgtcggccgagggctcgaagctttccgccaggaccgggccgaccgacagatcctgacggtggccgaccagcccctcgaccacgtggttcatgatcagatccgcggtgccgtcgcgctgcacgccgggattggtgctgcgcagatcggtcgggatcgcgatggtgatccgttccgtccgctgcgcttcatcggcggaaaaggcagtctgcggcaggatcagcgccgcggtgacgacggccgcggcgccaagctgccgcgtggtcacgcaggtcatgggtcttccccttcccttcgctgggtgatggtgaagcgacaccggcggcacaccaccggtccccgtcacgagccggccggacattgttttcggatcgtccggtccgggagtattgcgggggcggggcgcatgctccccatgcgcgccgcccgatctggtgtctgcgtcaggccctggtggcggccacggccccggccaggaagtcctggacggcgccgaccaccttcagcccttcatggcgcacgcccggcaacaggtcgagccgcacgggaatgcccttcgcctcgaacgaggccttcaggctccggatcttgtcgacccgggtggcgccggcgatgttggcatcgggcatccagccgggcatgcccggcttcagcgtgatttcccaggtgtcgagatcggcatcgcccaccaccatctgcaccgccacacggcgcatggcgtcgacatcgggatcggtgccgaacacctcgcgcagattgcggatgccgacccaccagtcgcgatcctcgtccagcagggtcacgccgccgggcgcgccgatcgagaccgcgaacagccggtcggcatgcagatagaggaagcggtgggtgaaatggccgccgcccgaaaagccgaacagggccacgcgcgagacgtcgatgtcgtagcgcttgcccaccagatcgaccatgtcgagcaccagccggtcgaagcgcatgtcgtggaatttgatgcgcttatagttcgacatctctcccggctcgatcagcccgacgggaaagagcggcgccagcacgatgcagtcatgggcgtcggcaaaggcggcgaaatggtcgcgataggccgccgcggtgcggccggtgccatgcatggcgacgatcagccgccagcgccggcgcgcctcggcatcggccgtggcaaagctcttgggcacatagaggcaataggagacgcgctgttcgttcggcagggcgaagaagggcgtcggcccgaaatcgtagaagttcagatgcggctgcgcgagggtgatgccgtcggggatcatgggcgcgggctccggcagggtcgggagggcaaggcaggcgggggacggccctggctcgtcttcgagcataggaccgcccgccgcgaaggccaagggcaaaaactgcttttatgacggttatagtgcagaacgatcattggcggcaccggccagccgccaaccgccgccgggtgccggctccagcacaggtgcggcggcgagcagtgcgcgggtataggcatggcgcggccgggcgaagaggtcttcggtcgccgccgtctcgacgatccggccatccttcatcaccgccacccggtgggcgatgcggcgcaccaccgacagcgcatgggtgatgaacaggcaggaaaagccgtggcgctgctgcagatcgccgaacaggtccagcacctgggcctgaaccgtcatgtccagcgccgagaccgcctcgtcggcgaccacgaaggccgggcggcggacgatggcgcgggcgatggcgacccgctggcgctggccgcccgagagttcatgcggcaggcgcttcgcataggccgcgcccagcccgacctcttccagcacctcgtccacccggcgacgcgcgtcttcagccgaaagcccgggcacatggcgcagcggttccgccacgatccgccccacgccatggcgtgggtccagcgacgagaacggatcctggaacaccatctggcagtccagccgccgcgcgcgggcctcggcgccggtggtgcgggcgagatcggcaccgcggaacatcagctgcccgccgctcggccgggtgaggccgaccaggcagcggccgatggtggtcttgcccgagccgctttcgccgaccagcgccagggtctcgcccggcgccacctgaaagctgaccccgtcgacggcgcgcttgtcgggctggcgcttcagcatccgccgccggcccttgtggatcaccaccagatcgcgggcctccaccaccggcacatcggcccgggcgggcggcgccagacggcgcggccgcggcatcgcctccagcaggttgcgggtgtagtcatgctgcgggtcgagcaggatccgtgctgtggggccgcgctcgatcacccggccgccgcgcatcaccaccacgtcgtcggcatagcgcgccaccagccccagatcatggctgaccagcaggatggcggtgtcgttctcgcgcgccagctctaccatcagctccagcacctcgcgctggaccagggtatcgagcgcggtggtcggctcgtcggcgatcagcagccggggcttcagcagcatcaccgaggcgagcatgatccgctggcgcatgccgcccgagaattcatgcggccaggcgccgaaacagcgcgccggatcgtcgatccggatgcgggcgagcatggcgagcgcccgcgcccgggcctcggcgcggccgatcctctcgtgcagcatcagcccttcgaccagctgcgcgcccaccgacagggccgggttgagcgagaccatcggttcctggaacaccatgccgatctggccgccgcgcaccttgcggcgcgcggccccttcgagcgtggtgatgtcgcggccgtcgaacaggatccggccggactggcggatcagcggtgccggcagcaggtcgagcaccgcccgcgagaccacggtcttgcccgagccgctttcgcccaccaccgccagaatgcggccgcgcgcgatcgacaggctggcatcttccacaactgttggtccgtgttctaggccaacagacagcttttggatgtctagaagcaggtcgctggtcatgcgttgcgcatcctgggatcgagccggtcgcgcagcgcatcgcccagcaggcagatgccgagcagggccatggtgatgcaggcgccggggaagatggtgagccagtcggcctgggccagatagggccggccggcggagagcatcgagccccaggtcgccgccggcggcggcacgccgagccccaggaagctgagtgcgctttccgacagcagggcccagccgaacatggaggtggcgagcacgatgatcggcgaggcggcattgggcagcacatgcaccgccatggtgtagagcgtggaattgccggtgacggccgaggcctcgacgaattcccgcgcccgcagcgacatcacgatgctgcgcaccacccgtgccatcgagggggtataggcgatgcccagcgcgatcacgatgctggtctcgcccggccccatcaccgccatcagccccagcgccatcagaatgccggggaaggcgagcagcgcatcgatgaccacggccagcatccggtcgaccgcgccgcccagaaagccggccagcacgccgatcggcgcgcccagcagcgtcgccaccgcgaccgtggcaagcccgatcgacacgctggtggtggcgccgctcatcagccttgagagcacgtcgcggccgaattcatcggtgcccagccagtgcagttccgagggcggctgcaggcgatgggggatgctcagcgccatcgggttgtagggcgtccagacggcgccggtgacggcaagcatcagcacgatgccgaccaggatcacccccagccacagccccggctgaagccggcgacgcagcggtttcaggccgcgggtatcggcggtggaagcaggtgcagaggtcatgccgcaaccctcggatcgaacagcgggtggagcaggtcgacgataaggttgatcaccacgtaaagcccggcgatgaagagaagcccgccctggacgaccggatagtcgcgggcatagatcgcatcgaccagtagccggccgagaccgggcagcgagaagatggtttcggtgaccgcaatgccgcccagaagattgcccaggatcagcccgaccagggtcagggtcggtgcgaaggcgttgggaaacacatggcgcgccatcacggtgtgttccggcagccccttggcgcgggcatgggtgacgtattccagccgcagcacctccaccgtattggcgcgcgccatgcgggtcaggatgccgatttcgacgatggtcagcgtcagcaccggcatgaccagataggcgagcgcccggccggcatcctcggcgaagccgacatagcccacgatcggcagccagcccagattgagccccagccacatcaggatcagcagccccagccagaaggtcgggatggacatcagcagggtggcacaggcggtgatggcgagatccgtgccggccccgcgccgccaggccgcgatcatgcccagcggcaccgcgaccagggtcgcgatcaggacagccgggaagaccacgccggccgtgaccgagaagcgatcggccaccagctctgccaccggcaggccgttggtgatggactggccgagatcgcccgaggccagccgctcgacccagagcacgaactgccagggccaggggccgtccagcccataggcctgacgcagcgcctgaaccgtggccggatcggcctgatcgccgagcatggtggtgaccggatcgcctggaatcgcgcggatcagcacgaagaccgcaagcgccaccaccacgagtgtcgggatcgccgacgccaggcggtagaggatgaagcgcaacatggcgggctccttttttgttggtccctcgccgggcgggcgctgccgcgcccttggccgccgcctcaatggcggaagtctgtatggccctcgccgggcggccactgccgtggccttggccgccgcctcaatggcgggagtctgttcgaccctcgccgggcggtcacttccgtggccttggccgccgcctcaatggcgggagtctgttagtccctcgccgggcggccactaccgtggccttggccgccgcctcaatggcggcttgggccagccgttgcaaggggcaacgactggccccggctcgtcgtcaggcgcggggggcggtgatcgcgccgtccatgtccagcgtgtaggtggtgaagcgggtcgacagggccggcatggggcagacctccatcaggcccagcgccggttccatcaccaccatggcgacggtggaggagatggagcccccggcccccggccggggcgggcggcagaccgaataggggacgccgaaatcgtcgaagaaggcggccttcagcacgtcgcggtcgatctgcccggccttggccgccagcgcccggcgcacccgccagtcgcgatagaagctttccggcacgaaggggatgccggtgtcgcggatcttggtgcgggcgatgtcgccgatccagtgattggcatgcacgatcatgccgttctcgtccggccagatcgggaaggcctcgtcgggggcgcattcgaaatcgatcgcgaagccttccgaccagctcagcatcatgttgttcgaggccgatttgggcgtgcaggacaccgccttcatcgccagcgccatatgctgctgttccagcgccttgcgccggatcagcgccagcggcacgccgacctgggcgtagtcgcggtcgctttccagataattggcggtgatggcgatgccggccgaattcaggccgcagcgcgccaggccgccggcttcggtcatggtcagcaggtcggggccgtcgtcgcggcggatcttcagcaccacggtggtgtgggcgcattccggccgccagtcccagttctggccgtggatcagccggccatgggccgtatggctgcccaggatcaccgcaccggtgcatccgtccggctcctcgtccggaatgccggcgcgctggcggccgatctgcaggatttcggtgcgggcattgatcagcaggatgtgttcaaggtcgcagcccgccccctcggcgatgccgcgcatctcttccacataggcggggtcgaaattctccaccagcggcaggaattcccgcgcgatggcggcgatcgccgaccagtcgtggttcatcgcccggagctgggcggtgtagagcgcaacactgcccagaacctgggatttcagcgccgcgccataggtccgcccccgctcgacgggggtgccgcgcagctcgaccatggggaaatcgacgacatcggcggcagatgtcggggccacgggtgggatcatcgggggaggttccttggaagagggctgacccatgttgcactgaaggcgtgcagaagacaatttttccgggccggaccgcgccgggcgcagcgccgtgcaacccgtgcttgatcggcggccgaagccgtggttaacaggggatgcatgcgcgcggccggccggcgaccgggcgcgccttccccacagagcaggctgtcttttcgatggtgacgatgcccgaggccgaggacgacgccgcaccgcaggccgggctgtcggccctgcagatcgaggttgcccgccgcatcctggaacgcatccgcgacggccgctgggcgccgggcgaacgcgcgccggagctggcgctggccaaggcgctggacgtgtcgcgcacgccggtgcgccgggcgctggaactgctggaaagcgaagggctgatcgcccagtcgcccggccgcagcttccggctgatcgaggatcccgccgccatcgaggccgccgctgcccgcgtcgaggcccggctgcccgcctcggataccgagcgggtctatcagatgatcatcgccgacaaggcccaggggcgcatcgcccaggatgtttccgaggccgagctgctgccccgctatggcgtctctcacggcacgctccgccgggtgctgatccgcctgtcgaccgaggggctggtcacccgccagcccggccatggctggcgcttcgtcgacagcctggacgacgacgacgcggtgaccgaaagctatgccttccgcatcgccatcgaatgccaggccctggctcagccccgctaccgggtcgacaccgcccgcttcgccgagctgcgcgccgcccatctgaaggtgctggccgccgatcgcgagacgctggacgagcgcgaatggttccgggtcaacgccgccttccacgaggcgatcgtggccggcgccggcaaccgcttcttcgaccaggccatcgcccagcagaacaatctccgccgcatccaggaacgcgacgagttccgccggctgacgcctgatcgggtggtgcagtcctgttgcgaacatctggcgatcctccaggcgatcgaggccggcaaccgccggctggcggcggccctgctccgccatcatctggcccaggcggcggagttccccgaggacgagggagggagtctttttttagcccctcgccgggcgggcactgccgtgcccttggccgccgcctcaatggcgggagtctgtttgaccctcgccgggcggccacttccgtggccttggccgccgcctcaatggcggctgggagccctgtggtcctgcggcggggaagaggctcactggcgatagtgcgcggccatttcggcggcgagggcacggtcttcgtcgcgggggctttccgccagcgcgcggatcaccgcggcgcggtcggcctcgggtctctcctggctgaacttggccagggcctccaccgtctggatgacgatctcgaaggcctggatccgcggcagcatcgcctggatgtcggcctcgttcagttgatccagcggccagggctgcggttgctgcgcctcgaaatgcgcaaccgtgcgggcaagcgccgcgcggttggcctcaggcccggtcagcaggcggatatgtggccggtcacgtgcagcgccgaatagttccaggtcggcgcatcggccccggtgacgtaccaggcgggggagacatagccgtcgggccccgtgaagaccgccagcaccggcacgccgtcacgaagccgcgccgcctgcgggttgacgcaggcgatatggccgagcagccggtcgccgggcgccaggccgtcatccagcctgagcagcggcagatggctggccagcggcgcaccgccctggggcggcacatccaccagcatggcgaagccgtgggcgtcgacgaaggccgcgcggcgcgcggcctcctcaatgcgatagcgtgcgggtgcatacatggcgacgggtgtcctcagccgcgcgaggcgtggaccggcggcagatgctgcgcccagggcgccgcctcttcgatccgcgccgccaggcggaacagcgtcgcctcgtcgccgggacgggcgatgaactgcacgccgaccggcaggccgccgtcgctgaagccgcccggcaccgacatcgccggctggccggtgacattggcgatatgggtgaagcccagatggcccagcacccgcgcgagatagacgtcgaggtccagcccgtcactgtccagatagccatgggccatcggcgcctgcggcagggtcggggtcatcagcaggtcgtaatcgccgaagaagcggcaaaaacgccgggcctccgcccccatccggccgcgggcatccagcagcgccggcgccggcgtggcccggccgcgttccgccgcagccagaatgccgccttcgaccgtgctgcgatcgaccggccggcccatgatcttcgacaggtcgtcgacctgcgccgcatcataggcgcagaccatcagcttcagcgcctcggcaaccgcctcgccgtcatagaccggcacggcctcgaccacctcgtggcccatctcttccagcagcttcgccatgcgcagcgtggcagcgcggacatcttcggtcacctccaccggcaccggcggggtcaggctgagggcgatcttcagccggccgggggcggcggcgacctcttcgaaccacggccgggtcttgggcggcgcaaaatagggggcgccgacatccgggccgtcggtcaggtccagcatcagcgcgctgtcgcggacgctgcgggtgacgacgtgttccgaaaccagcccaccccacagatcccacgacaccggcccggccggggtgcgggcgcgcgagggcttcagcccgaaggtgccggtcgacgaggccgggcagcggatcgaacccgcgccgtcattggcataggcgatcggcaccatgccggcggccaccgccgccgaagagccgccactggagccgccgacgctgaaaccatgcttccagggattgtgcgtcggcccattcgcaaccggttcggttgtggcgttggagccgtattccggcagattggtcttgccgaccacgatcacgccggccttgcggtagcgcgccatgatctcggtgtcgtaatcgcgggtgaaaccggcggccaggcggctggcattggcgctgggcacaccggcataggactggcaatcgtccttcagcagcaccggcacgccatagagcggggtggccgcgggatcgagccggtcgagcgccgccagctgctcttcggcctgggcctccatgcgcatgatcacggcattcagggcaggatcgacccggtcgatcgcggcaaaggcggccgcgacggcctcgcgcgggctcacttccttcgcacggatacgcgcggccagcgcgacggcatcatccgtcgcataggtctcgacgaagctcatcaatctgccctctgttggagcggggtgcatgtggctgatgaggaggaccgtaacaaactgcgttctgaacgtaaataagacagtttaaaaaatgcgaagccgcatcggcgcctctccgtcgggggtgatctcgaccgccgcggtcatgccggcgaccagttcgaccccgggcggcaccgcatcgatccggatgcggacggggatgcgccgggccaggcgcacccaggcgaatgtctcaggcacatcgggcaggccctgcgcgccgggcgtgtcgttgtcgttctcgataccgcggccgatgctgtcgacatggcccgacaacggccggtcgaaccccatcagccggatctgcgccgggcgccccgggtggacatggcggattttggtctcttcgaaatagccggtgatccggaagctgccggcatcgacgatcgagatacggctttcgcccgcgatcgcatagtccccgggccggaggcgcagggtgctgacatagccgtcgaccggagaacgcacggtcgtgcgcgccagatcgagccgggcgagatccagccgcgcctgtgccgcccgccagtcggcatcggccaccgccgccgcggcctccacctgctgaagatcttcgcgcgagatcgcctcgcggagccgcttgcgccgctctgccgccgcccggcggacgatcatctcctgacgcctggcttcgacatcggcctcggcggaccggacggcaaggcggtagcgctcggggtcgatgacatacagcacatcgccccgctgaacatggccgttgtcgccgacctcgaccgtggcgacggtgcccgacacctcgggcgccagccggacgacatcggcgctgacccggccgtcgcgggtccagggcacctgctgataccgatcccagtactgcagggcgatcacggcggcgggcacgacgatgcagagggtgaggacatagcggccgaggcgggagaggatcctggtcattggaaaagcccggtggatggcaggtgctggagcagcagcccgtaaatgatggcgaagacggcaagctcgacgagcggccggccggcgaagaggcggctgagccccgtgacgaccagaacccggatcaccagcagggtggcaacgagcgccaggaccgccagcaccagcaggccggggatgaaaacgccgccgagggcgagatcggtgatcatgggtgtggctccccgtcgggcgtgccgccactgcccagccccagcgcgaagcgcagatcgatgatcaggtcgagcaggcgggcacggttgtgaagcgaactgccggcgatcagcccggccagcgcccggatgcgcggctccagcccggcgatctggccggggtccggctgccgggccgcgaagccggccgcgatcgccgccagcagcccgcgggcatcgcggccgatatggccctccacccggccgatctcgtggcggagctgcccggcggcatggccgatgcgcagatgatgcatggtatcgtcgagcagatggccctgcaggcggcccgagagccgcagcctgggcagcagcagcgccgtgcggtcgaccatgaggttcgtccaccaggcctcgtcgggggcggtgccgagaatgcgccgccggacatccctgcggctcagccgcagcaggcgtccgatcgccgcatggggcgggacggtctgaaaaatcgtcatgctcaccatcgcaaagccgacggccgcgaacagcgcgaccacgttgttgagggcggcggcgaaatcgccgtgatagacgctgtccagcccgcccaggatcggcaccgtcagcgtgatgccgagcgccatgaaggtcgtgggcgggcgcgcctgcagggatccggcgaacaggaagacgggggccaggactacgacgagaccggcgaaatccggcacccgtggcaggatcgcgaagccgtagaccaggctgatcgccaccccgtagaccgagcccagcatgtaggtccgcagatgcggcgccggcgcatcgacggttccgaacagggcacagcacacacccaggatcgagaccgccatcccgccatccggccagcccgaccagatccagaacaggcagcccatggtgatgccgatggcggcaccggcccccgccctgaccgccatccacgggtcgcggtgatagacatagcccctggccggacggggggtcgatcggccggggccggccctcagggcctgttgccagagccgatcagtgtcacgaagcaggccggccatcagggccagacggccggcgagattggcggccagccggtcgcgcggcgtcgccgcccccgcggcaagccgggccccgagggcttccgcccggtcgatcaggccgctcgccgcggctgcccgcgcggcggcatcgtccatggcgatccagcggcggagatccgccaccagccgcgcggtttcgtctgccggatcgcctgtctcaaggcccagggcggcgatcttttcttccacctccatcgtcagcggcagcaggtgggacagccggtcgtggatcatccggcgcagcccgatatgcggcaccagcggtgccggatcatagggcaactgcgtgccgagcccctgcaggccgagaagatcggcggcaagctggcggcgatcatcgcgcgtctgccgcgccgcggccccgcccagggcatcatccgccaggcgccgggcatcgcggagcgtggccgccagccggccggtgaactggtcggtcgcatgtttgggcagaacgatgcgatgaaccagaaccgcgcagaggatgccgaccgagatttcctgaacccgcaccagggcggtggtgaagatctggcccggatcgagcacgcccggaaagccgatcaggctggcggtgtagccggccagaacgaaggcataggcgcggggtgtgcgatcgagcagggacaggccgaggcacaggccgatccagcaggcgagcacgatgctgcacaggatggggtcgttcacgaaggccggaatgatcaccaccgtcgccgccgcaccgaccagggtgccggcaaagcgatagacgccgcggccgagcgaggcgcccgccgagccttgcgagacgatatagacggtcagaaccgcccaatagggccgcggcagtccgatccgcagcgcgagataacaggccagcatcgcggcgatgaagctttttgccgagaacagcagcgcgtctgcatccgcccgcagcaggggcgaacggcagaggcgccggaggtgacggccggctgcggcaatgggacgctcggggcgatgatcggtgctcatgccgcagagtatcgccgcggtgccaaatcggttaaattcgatatccggtcataaaatcactaaaaactgccaaagcgatgtgcccctccccaagatctgccgtctccgccgtctcggtcttcgatccggacctcaccgaccggccggcggtcgccagccagctcgatttcgcagaccatgcggaagaggtgccggtccaccggcatcgcaaggggcagttgatcctggcgcggcgcggcgcggtgacctgcacggcggataacgacatctggatcgtgccgcccaattgcgccgtctggatcccgggcggcatgccgcacagcgcccgggcgaccgcgaacgcccgcctcagttatctgttcgtggaaccgggcgccgccctgctgcccgacagctgctgcaccctgtcgctctcgccgctggtgcgggaaatggtcgaccggttggctcaggagccggcggattatccggccgacagccatgccgcccggctggcgcgcgtcaccctggacgagctggcggggatgccgcgggagcgtttcaacctgccgatctcgagccatcccaagatccgcgccatcgccgacgctctgaccctcgacccggccgaccgcagcacgctcggtgactgggcaaagcgcgtggcgatgagcgaacgttcgctcgcccgcctgatgatccgggaaaccggcctgaccttcggccgctggcgacagcagctgcacctgatcgtcgccctgcgcacactggccgccggcaccgcggttcagaacgtcgcggtggaactgggctatgagtcggtcaatgccttcatcgccatgttcaaaaaggcgctgggcagcacgccggcacagtatttcgcccagcggcggcgggggtaaggccggccaggcccagaccgttcagataggtaaaagtgcagccggccgacatgggtgacagctgtgcaagatggtcgcggaggtgcggccatggcgtggcaagagacccgtgtgatggatgagcggttgtgttttgtgtcggcgtgcctcgagggcggcgacagcatctcggagttgtgccgtgtgttcggcataagccggaagacggggcatacatggctgggtcgctatcgccgtgacgggttcgcgggctggaggatcggtcgcgggcgccgcatggcaatccacgagcggttcctgatcggccccgagacctggcgggatcgcgatcccgcaccaaaccaaggccggaaccggggtgagctgttacctgtgtcgccggtctgaagtgttgcccgtctttccggttgctcaaggagactaagcgaacatcgaccgcccaccatatggcgatagcgggcgatcatatggttccagcggattgcgatctgctataaaatgtgagcaggtctcgaaggagtatccgatgcagcggcgacttcgcaatatccttctggcagcggtcgcggcggctgcgtcgatatgcgcccacaccgcgggcgcgcaaagcctcacgcccgagcagttgcgggccctggtggacaagcgcgtcaccgcgctcaatccgtatcaggaactcctcaacgatccggatccggcacgaagcctggctgccatgcagatcatgctggagagcgacgatgccgaactgacccgtcttgcattggagttcgggctgctgtcacccaacccttcggtgaaacgcgccgccttcgagagttttctcaaaacccgcccgatcttctcgattcgtctggacggcagggcagtgaaggacaacgactttaccggcgtgattcgggatcggtggaacggcaacgttacgcctgaaaagatcgcgtactggcggatcggcgtcggtgactactctccggacaagcgctgctacgtgaatgcgaatgcgggtaacgagtgtttcgtgaccgtcaatgcggatggcatctttctgactgcgagctacctgaatgcgcgggggatcatcggcgatgacggcgccattgcgggttcagccaccttgggggcggtagacgaaccggtaccgttcgcgatcaaactgctcgaatgaggcaaactgtcgagtgaggttactcgacaatcacgtcgtcgatcacgaccggaccgggaccccaggcatcaaggatcgtgaacgcaatccaccggatgttgcgtggtgccatccggccggtatcgaacaggccgtcgggggccatctggccgcgggtccattcccggaactgctgcccttcgtcgtcaagggaatactggacgatgatcgttctgggcagcgcatagtctgcatccgtcggtgcggtcatccggacacgatgcactgcggcgacgttgccggtggcaataccaaacacgatccgggcgcccggtacgccctcatagacgaaaacgccgttgcccgtcagattttccgggccatagcgtgggttgacgggcggtatagagctgcggacgaccaccagcggtagccccgccgccgccggcatcccggcggctggcggtatcgcaccggccggcggggcgccataggccgccccctgttcattcagaaagcggtgcaggtttatcagaatctcttccgaacgcatgaaggtcgcccgacgagggtccgcagaagcataggccatgccgatcggtgtttcgccgacgaaggcgaaggcaccggacgttccctggctgatctcgcgaccggccaggatctcgccctcaagagtcaggtagccgcgctgggtgatccgcagcggcacacgctcttcctcgcccgtgggtgtgaggcgcagaaggctggcttcggccgcccgcctgccagccgcgtcgacgtcgagtgcgtccagctgctcgctgcagcgatccgtgccgatgccccgtatcacggcaagtgccagatcgatgccatcccagaacggtgtgatcacggtgcccgtcccggtctgcaccggtgccgctgtggaaacggtcacgcgcggaaagatgcccgccacgtggcggggcatcaccgcatagcaggtgcctgcctgaccgaacatccagccgaagccattctctccctcgccgttcttcacggaaacggtttgtgcaaatgcggatgttccgtaaattgccagtaggacgagtgccgaaaggatcacggtcatgacgttgcggaaaagaatcatgtctgtctttctcgcggctctcttgattccgacccctggggcgatggcacaggacgaaccggcactcgaactcggccaggatggcttcagggagatcgtccggccaagtgcattgatttccggcgcgatcgtcaccggcgtgcaggtctatgctgcggcacaggacgatatctccatgcgtggcttcgtcccccggagctgggccggtgaaagcgtctgtgcatctgttcttacgatcaacgggctctatgaggcaacggcgacctacagaattccggctgaatggccgggtggaattgcactgcttcctttcccgaccgtgcatgcggacattctttccaatgccggatccgatggcctgtcgatccgtgtcagccggaatgcctgtggcgcggagctggggcgtgacatgtcctttgcgctctggaatggcggtgggggaaacaggctgaccgtcctgctcaactcgttccgggccgatgcggtctatctgtatgttgccgggcgcgagacgccggtccgctgccgtatgatcgatctgccggcccgcagcgcattcgatgttgcctgcgatctgtccgtcgacggtcttgccggtccgacccggatcgagatcctgcgcatggtggaacgcaaggttgcgccgcccaccgatttcgttctctggctgccgcaggagtaggcggtgcgatacatggcctttctgaggcgcttcgtctcgggcttcagcgttctggttgtggtgacggtcgtctttctggcgacgaccgcgaatgatcgctcgttccagatcgaggccgagactctgggcgccgcgatcactttcgaaggcgaccagaacatctggaacttctcggctgccatcctgtgcctgccgcgggcgatacctgatctgcggcagctgacgacggaagcggtggatcgggataccgcctgtaccgaggcattcttcgaactggcggagcggacggacctttcgatccactggcaccatggtgacgaggtcgcagtttcggtcgacggcgaggggcggctggagatcgagatcaggcggcgtcgggagacggatgtacccgagcacgcctttctggtcatacccgccgacatttggacccggcagggggccctgaccttcgtcggctctgcgcgcatcggcggtgatatggcaacgggggcccgcgactatctgcgcgccggcaggtgggacgtgcggcagacaggcatcgccaattctctgtttcgggatgtcaccgaggtggtgaagcgtggcgactttacgttgggcagctccgttcaggttctgaatgccggcatgcctgccacgctcttcggcagtatcacccggtcggcggaagcgggcatacggctggtcgccctctccgaacggggtgaggtcgaactgcaggtggcctatttcggggtgggcactccggtcattctgcgccctgactggatcgacagaatcgtctccagttcggtgctcatcgcactgatcggcgtcatgaccttcgcgtcgagcattttccagatattcatgtttgcccggtccgggcgcaacctctgatcccctggagggcaatccggtttgctccgcggccagtagcatgatttttcatcatgcaatgcccaatattcatgcgttgtgatgccagctggatgatcccatacttgacctacaaataaaaatgaaggtcaggagacatgcgggatatgatgaatcgcaggcggttcaacaccttcctcggcgcgggcatggtctcggctgcggcagggctgaaaatcgggatggggcaggccttcgcggccgatggttccttccagcgggtgaagaattcgggggttttgcgcatcggcggcgtgccggatggcgccccctattacaagaagagtctgaccgacggcagctggcagggcttttatatcgatatctgcaagaagcttgcggatgatctgcgcctcgaactctcggtgctggaaaccacctggggcaattcggtgctggatcttcaggccgacaaggtcgatgtcttcttcggcctgaacccgacgcccgagcggcagaaggtgatcgacttctcggtgccggtgttcaacaacgccttctcgctggtggcgaaggaggggttggaggcgaccagctgggaagacgtgaacaagcccgagatccggatcgcggtcgatgccggctcgtcgcatgatgccgccgtgacgcgccatgcgcccaacgcaaccgtcgtgcgcctgaagaaccagagcgacgccaccgccgccctgcagtcggggcgggcggatgcgcaatgcctggtgctggtgctgggcctgtcgcttcgggccaagaacccgaagatcggcaagctgatcatcccgacgccggccgactacaccacctcgaatgccggtttccggcgcgaggacgaccagtcctggcggcagttcgtcgacggctggatcaaggccaaccgtgcgagcggcttcatcaaggatgcgatcatccgcaacatgcagctggtgggtgtgaaacagtccgacttcccgcccggtttcgacgtctgatctccccggatccgcggcggggccggctgccgccgccgcggatccgctgccaccctggaccgggagatccggatgtacgagtgggatttcggcctgttgtggggctatcgctggctcttcctcgacgggctgtgggtgacggtgtcgttcaccgtcgccatcgtggccgggggccttgcggtcgggctggtcggtgcgctggggctgctctgccgcttcgcgccgctgcgcctggccagcctcgccttcatcgaggtcttccgctgcacgccgatcctggtgcagctgatctggtgctattacgccctgccgatcctggcgggtatcgaactcagcgccaccagtgcggcgctgatcgcgctgtcctgctatggcggtgccttctatgccgagatcatccgcggcggcatcgtctcgatcgatcccggccaaagcgaggcgggggcggcgctgggcatgacgccggcgctgaccatgcggcggatcatcctgccccaggcgctccggcgcatgatcccggcgctgatgaaccagtcgatcctgcagttcaagaacacctcgctggtctcggtgctggcggtgcccgatctggtctatcagggccagatggccgcccatgacagcttccggccgctcgagacctataccgcgattgcggtcgcctatttcgtcatcctgttcccgctgacgctgttcgtccgccatcgggagcgcaggctggggagccggtcatgaccgccgctgaaaccaggccgcaagagaccaagatcgagatcgccggcctgcagaaatccttcgggcccctggccgtgctgcgcgatatcggcttcaccgtgcccgcgggcggcgtggtctcgctgatcggaccgtcgggctcgggcaagtccaccttgctccgctgcatgaacctgctggtgacgcccgatcgcggcagcatccgcgtcggcgatgcccgcttcgtcttcggcagcggtgcgccgttgccctcgcatcgcgagctggcgggctttcgggcgcgcaccggcatggtgttccagaacttcaacctcttcccgcatatgaccgtgcttcagaacgtgatggaggctccggttcaggtgcggcgccggcccaaggccgaggcacgggagatggcgctggcccagcttgaaaaagtgggcctggtcgaccgggccgggcagatgcccgatacgctgtcgggcggccagaagcagcgggtggcgatcgcccgggcgctggccatggagcccgaggtgatgctgttcgacgaggcgacctcggcactcgatcccgaactggtgggcgaggtgctggcgacgatcctgaaactcgccgccgacggcatgaccatggtgatcgtgacccacgagatcgccttcgcgcgcgaggtgtccgaccgggtggtgttcatgcgcgacggcgtggtggtcgaagacggccccgccgcccaggtgatcggcgatccccgccaggacgccacccgccagttcctcagccatttccacaaagccatctaggaccaagccatggagcgcattgaacgactgcgcgtcttcctgatcgaaagcccgatcgcgatggcccggctgcagggcgtcggcaacgtcaagggcacggtcaagcgcgtcctggtcgaggcgacctccacctccggccttgtcggctggggcgaggcggccccctgggaggtgttcaccggcaccgccgaagcggccttcgccgcgatcgacgtctatctgcggccgctggtgaccggtgcgccggtcaatcgcatccgcgctctgacccgggcgatggacaaggccctggtcggccatggcgaggccaagctcgcgatcgagaccgcgctgttcgacattctgggcaagcggtcggggctgtcggtcgccgagctgctgggcggccgggtgcgggatgagatcccgctctccttctcgatcgcagatcccgatttcgacgccgatttcgcccgcatgcaggccatggttccggccggcaaccggatcttcaaggtcaagaccggggtcaagccccatgccgaagacatggcgcatctggaggcgatccgcgacgccttcggcgagacggtcgaccttcggctcgactacaaccaggcgctcgatcccttcggggccatcgccatcctgcgcgatgtcgaccggttccggcccaccttcatcgaacagccggtgccgcgcgactgcctggcggcgatggcgtccttcgcggccgccctcgatacgccgatcctggccgatgaaagctgtttcgacgcccgcgacctgctggagatcgcccggctgggtgccgccgatgccgtctcggtcaagctgatgaaagccggcggcatcctgaaggcgcaggcgctgatggccgttgccgatgcgctgcatctgccgggctatggcggcacgctctgggaaggcggcatcgcgcttgcggccggtacccagttcatcgccgcgacgccgggcatgtcgctcggctgcgaattctacatgccccatcacgtgctgaccgaggatgtgctgctggagcgggttcccaaccgcaatggcagggtgatcgtccccaccggccccggcctcggcatcgaggtgacggaacagtcggtgcgcggcaatgcccgcatcctcgccgaagcctgacatgccgccgctgcgggcctgataccggcgccgcggcggcgcccccaggaagcagagatgtcccagacgaacgagacgcaggccgtcgtcatcggcgccggcatcgtcggcgtgtgcgcggcgctggcccttcgccaggccggcctggccgttaccctggtcgacccggacgagcccggcggcgagcacgcggcgagctatggcaacggtgctttcatcacccccgcctcgatcatccccatgtcggtgccgggtctctggcgcaaggtgccgggctatctgctcgatcgcgacggcccgctcaccatccgctggcggcatctgccgcggctcaccccctggctgctgcgttttctggccgccggcatgaccacggcgcgggtggagcgcaccgccgccatcctgtccggcctgctgcacgacgcacccgaccgccatgccgccctggccgcggcggcagacgtgccggggctgatcgagcggcgcggcgtgctctacgtctaccccgaccgtgccgcctttgcggccgaagccctgtcctggcggctgcggcgtacggccggtgtggtctggcgggagctggacgcggcggatctgcaggccttcgaacccgccttgtcccccgcctaccgcttcggtatccacgtgccggcagcggcgaattgcgccgatccgggggcctatgtcgcggccctggcggctcatggtgaacgtctcggcgtccgccgggtcaccgcacaggccaccggcttcaccttcgagggtatgaaactgcgggcggtcgagaccgatcaggggccgatcgcctgcaaccgggtggtggtggcggcgggcatggcctcggcacggcttgccgccgcggcgggggaccgtgttccgctggaggccgagcgcggctatcacgtccagctgaccggcggtgccccgggcgggccgcatctgccggtgatgccgagcgacggcaagatggcgaatatcgtcacgcgcgaggggctgcgcgcggcggggcaggtggaactggcggggcccggtgcgccgccggactggcgccgggcggagatcctgctgcgccatctctacgccacctggccggggctttcccgcgatctgccggtgcgccgctggatgggcaaccgcccttccacccccgacgggctgccggtgatttcggccgcccgccgcagccccgatgtcttctacgccttcggccatggccatgtcggcctggccgccggccccaaaagcgcggcgctggtcgccgccctggtcaccggatccacgccacccctgtcgcccgcgccgttcgctgcgacgcgcttccggtggtgaccggtcccgcgatgacccttgcctcaaaaggatcgacgatgcgtggtgcagacattctggtcgagatgctgatcggttacggcgtcgacaccatcttcggcgtgcccggcgacaccaatgtgccgttctacgaggcgctgcagctgcgcgccgacgagatccgccatgtgatggcgcgcgacgaacgctccgccggtttcatggccgatgcctatggccgcttcaccaaccggccgggcgtgttcgaatgcccctcgggcgccggggcgatgtattcgctgccgccggtggcggaaagcaacggatcttcggtgccggtgatcctgctgaccatcgacatcccgctgccgggcgagggccggggcgtgctgaccgagcttgactgcgcaaagctgttcgagccggtcaccaagctgtcggtgcaggtgaagtcgccggaaaaactgcccgagatcatccgccgcgccttccgtgccgcctgttcgggcaagcccggcgcggtgcatctccagatccccgaggacatgctgctggccgaggtcgatccggcccggatttcgctccatgtcgaggaggaatgccggaccttcccggcctatccgaccctgccgcccgagaccaagttgacccgtctgctggaactgatcgcccgcgccgagcggccgctgatcatcgccggcggcggcgtcaaccgcgccgatgccggcgacgtgatcaccagcttcgccgagcgccacgatatcccgatctgcaccaccatgaccggccagggctcgatccccgacgatcatcgcctggcgatcggggtgatcggcgacaacggctatcacccccatgccaatctggcgctggagaaatccgacctcgcgatcttcgtgggctcgcgcatcggatcggtggtcaccatcggctggaccttcccgcaggtgacgctgaaccgccggctggtccagatcgacatctcgcccgaggtgatggccaacaattacgaaaacctgctctcggtgcagggtgatgcgaagctggtcttccagcgcttgttgcagatggaaaccgacaccaaccccgcccggcgcagcggctgggtggatgagctgaacgccgaccgcgcgcgtttctgggagagcgcggcaccgctgctgaccgacgagcgggtgccgctgcggcccgaacgcgccgtgcatgccttcaatcgcgcgctcgaagcctcgggccggccggcgctgatctattccgatgccggcacgcccacgccctatatgacccgtttcctgaagatcaacgaccgcgagacccgcttcgccatcccgcgcgccttcggcgggctgggttcggccttgccggcgacggtgggcgcctgggcggcggatcccgccaagcggccgatcggcctgttcggcgacggctcgttcggcatgagcgtgggcgagcttgagacgcttgtccgccttcaggtgccggcgatcctgatcctgttcaacaacggcacctatggctggatcaaggggctgcaccggctgaagggccacaatcagtgtttcggcgtcgacttcctgccgccggaaggccaggccatcgctgaagctttcgggctcaaggcctggacggcacgcacgggtgccgaactcgacgaggcgctggccctggccttcgcctggaagaccgggccgtgcttcatcgacctcaggatcgaatccctggcggagcgggtgccgccggtctattcctggctgcgccggcgcggtgaggatccaatggcgctggacagcgccgatcacggataccgctgaggtcggatcatctcaggcagccggatcatctcgggcggtggggcgcggcgcgggcagcaggttccgccgccgcgcctcggccaggaaccagcggcggaaggcggcgacgccgttctggctcatgaaggcttccgggcagcacatgtagaagccttcgcctgaagagcagcgctgggggaaggcgggcttcagccggccgtcggccagttcggccaggacatagctttccggcaccaccgccagccccataccggcgatcgccgcctcgatgatcatgtcggtgaccgagaagcgcggccccaggatcggcccggtgaacgggatgtcggccgcgcgcagccagtgcatccacaggctcggccgcgagacgttctggatcagggtgatccgccgcagatcgtcttcggcgaggaagccttgggccggcagcagggccggggcgccgaccaccacgaggtcttcttcaaacagcagatggctgcggcaggcggcccagttgcccacaccgcgcaggaagaacagattggcgtcgaaatccgccggatcctgggtattggggcaggccaccacctcgaacaggatctcgggctcggcatgtgcgaaatgtttcagcaccggcagggcccagcgccgtgccaatgtgggtgacatgccgatgcgcaggaagtcttcggtggtccggccgcgcaccgcatcgatggagacttcctccatccggtcgagcagatgcgagatttcttcgtaataggcccggccggctgcggtcaggatgatgcgcgggccggcgcgttcgaacagggtgacgcccagaaactcttccagattgcggatctggcggctgatgccgctctgggtgacgcacagatcctcggccgccttggtaaagctcagatagcgcaccgccgcatcgaaggcgtggagggcagacaggctgggcaggaagcggcgcaagctcgtctccggcggtcagaacccggccgggccgggtatcggtgcaccgaccggtgccaccaccagccggccgatgccgtcggccgccagcgtgaagcgcagcagaatgaccaccgggtcgggcaggccggtcgggtcgaaatcgcccgccaccgccaccctgaccgcaacctccgccccggcttcctgccagtcgatcggggtgaagcgcaggcggatggcgaagatctcgtgcgccgcccaggcgccgatcgacggccggccatggatcagccggtcgccccggaccacctcggcgccttcggtgaacagctggcggaaactgtcgaaatcatcctcgttcacggcctcgatccagtcgaggacaaggggcgtcgccaggttggacaggcgggacatcagcggtgcatcgggcatgacggtcggtccgggcagcgatcggtttcgtggcatggtcacatctgatggacgtggacggacatgatgccggtcacctcctgacgacattccgtcaggagccggacaaaaaccgcgatccgccccgcatgatgcagcgatgatcgggccggcggcgctcaggtgattggctgtttccccccagccggtaagcctgcgcctgcgtgggtgatcacgtcaagaccggtcttcgatgtttcacgttgcagtccgcacgatcctggccaccagcccgtgcagctcgtcgacatagccggtgcgcccggatggcgtgtcggggtccgaggtgatcacgacgaccatgtcgatgccgggcagcagatagagcagctggccgccatagccccagccatagaccgccggccggacgcccgtctcacgcaggaaccagccatagccataggcatcgccggtgaagggcgaggtggtgcggggcgtccacatctcgcggatccacccctccgacaccagccgggttccgtctgccgcaaccccgccccggcggagcatctcgccgatggcaagcagggcgcggggcgacagcaccatctggttgccgcccatatagacgccctgcggatcgcgggtccagggcgggatggtgatgtcgagcggatcccccagccagtcgcgggccagcgccagcgtgctctcgccgctggtgcgggtcaggatcgccgacagcagatgcgaattgccggtggaatagagcatccgcccgccgggctccgccacgaagggccgggagagcgccgtgcgcacccagttccggctttcgacccaggcgccgtaataggggccggaggtccgctccagcccggcctgcatcgacagaagatggccgatggtcagccggtccagccgcggatcgggatcatccggcaggtcggcgggcagcaggtccgccactttctgatccgtgccggtcagcacgccccgatcgatcgcgatgccggtgagcagggcgatgatgcttttcgacagcgatttgacgttcaccggtcgcgtggccggcgggccgcgatagacccgttcggccagaacctcgcccgcctgcgccacgatcagcgtgtgcaggccggtcaggtgccgggcatcgtcgagcagccggtcgagcgcgggcgccgccgcccgcccggcccgcggggcgatggcggtgacggcggcgagcgcgaggccgccggtgatcagccggcggcgggagggcagatatccggtcatggaactggagttggggcgatgcccggccggatcaacggccgggcatcctgtggtcacgcctggcgtgtgtttcgccacaagccgtagagccccgccacatcgcccgagcagagcagcggcatggcctgccggatctcgtccagtggccagtcccaccacgccatctccagcagcatggcgacggcatgctcgtcgaagcgctgccgcaccggccgggccggattgccggcgacgatggtgtagggggcgacgtcgcgggtcaccaccgcgcgggttgcgatcaccgcgccatggccgatggtgatgcccggcatgatcaccgcttcggcaccgatccagacatcgctgccgaccaccgtatcgcccgccggccggtagccgttctccgccccggcgaaggcgggttcccccgtccaccagaagaaggggaaggtggagacccagtcggcgcggtggccctgattgccggccatgatgaaggcggcacccgtgccgatggagcagaacgagccgatgatcagccggtcgacatcatcgcgatcgggcaccagatagcgggcgcaatggtcgaagccatggccatgataccagccggaataatagctgaaccggccggccgtgatgttggggttggtgatctggtcgcggatctcgcggcccttgaacgggctctcgaaggcattggtcagaaagggtgtggtcattgattgagcattccgctgcgcgtcgtcctgtatttccgccatgcgccgggcatgacgataggacagccttgaacgatatgttcaggctggaaacaggttcgcgctgggtctggcggccatgatgctcatggggcgggatgttaggtcagcggccatgccggggcaaggctttcccgcccgtcagaccagccgccggatcgggcgcttcttccagatcaggtgatagagcgccgactgccccgccgccagcaggcagaaggcgaccgggtacgacatccacaccccttcgatgccgatccgcgccgacagcgcccagccgaccggcaggccgatggcgagaatggcggtgcccgagaccagggtcggcagcagcaccatgccgctggcccgcatcaggctggaggtggccatgcccatgccatagatcaccagcgcccagaccacgatgtgcaacagggtgcgggcttccgcgaccacggccgggtcggccaggaacaggccgagcagggggcctgaaaacgcatagaccagcgccaccagactgccggtcagcacgaggttgaaggtgagcgcggtgcgcaggatttcggacagccggtcggtgcgcccggcaccgatcgcctgggcgccgaagatcgaggcggtgatgccgatcgagatcgccgggaactggacatagttcacgatctgggtgatcgcgccataggatgcggtcgcatccgagccgaagcggttgaccagcgacaggatcaggatttcggaaagcgagatcagcaccagcatgatgccggtgggcaggccgatgcgcagcaccttggcgagcagcacgcggttgaagccgagcgcgcgcaggaacgcgccatccggcgccagcggatggttgcggcggcgcagatggatcaccatccaggtggtggcgatggtcatggagacgatcgaggcccaggccggcgaggtgacccccatctgcggcagcccggcccagccgcggatcagcgccggggtcagcaccatgccgatcagcgtggcgaggccaagggtgaagagcggcgtgatcgtgtcgcccacgccccgcagcatggatgtcgcgagcagatagaggaagatgccgggggttgcgatcagcatgatccgcgcataggccaccgcctgcggcaacacatcgggcggcgtgcccagcaggctgaggatcgcggtggtggccgtgcctccgaagatggccaccagcagcccggccgccaccaccacgctcagcgtcgtggccgcgatcgccttgatctgcccggtctcgccggcaccgaaggcctgcccgatcaacaccgccgcgcctgcgcccagcccgatgatcagcgagatcatgaagaacatcagcggaaaatacgacgtcaccgccgccagcgccgacacccccagcatctgcccgacatagatgttgttgaggctgcccgacgccgcctgcagcagattgctgccgatcatcggcaccagaaacgccagatagggcttccacaacggctgtaccggcgccttgggcgagaagggcgacacccgcggcttgccacggccggccggcgccggagaacggggggagggggcagacatcgggggcgctccggggcaggcgtgcgggatggggctggcactctagcagggggcggggtggggggctatgggcagagcgggggtggtgggatggggggacagggaacgcgtggccggctctgatccgcccttccgtatctgccgccgccggacctcgtgcgcaacagccggtcagtcatctgcatgttgcgctgcaacgtttcgtaacacgacaaaacatggggaaagtcaggcggctgctattttatgaccgattgaagcaacaggttgggtcatggccaggaaatcccgctcaggaaaggtctctctgcgcctgatggctcttctggtgtcggtcataccgtctccctgcatagtcattgcggccgcaggggcgcaggagatgatgtcggtctctgtcgtcgttgcgagagaaggcctgctcacggaccagatctccatcgtcggaacgctggtgccgcgagaggaggtggaagttcatcctctcgtctcgggccagccgatcacgcgaattcttgcggagacagggcagtacgttgaagaagggcaggcgctggccatgctcgataccaccgatgcgcagatgctgctcgacaagaacgccgtcggcaccctgcgggcagaagccgctgtcgccgtcgcgcgcagccgggtggatgtggcgctggttgccgaagcagaaagcagacgaaggctggagcgtagtcgtgccctgcaacccaagggtgccgtgtccctgcagcttctggatgaacatcagaatgctcatgctcgggcggtcgcggagcttgctctggagcgtcagtcgctcgcacttgccgaagccgaggcggacctcgtgatccatgagcgccgggaaatagaactcaggatccagcgtggcacgctcatagccccgacggcgggggtgatcctcgaccgcagggcccgactcggcgccctggcgtcggatgcaggtgatgctcttttctcgattgcggagaacggtctggtggaggtcgtcgcacaggtcgtggaaacggattttgtccggcttcgcgacggaatgcatgccgagatcaatctgccgggacggagcgatccggcgacgggcacgctcaggatgaaagctgcgcagatggatccggtgacccgcagtggcgaggtgcggatccgactggatgagaatgatcgcgtcacgccgggcatctttgcgcgcggccacataaaaatcgccgaaagacgcggcattctgctgccgggcacggcggtcagaagccgcagcggtgaggatatggtctatgtggtggcgaacggggtcgtggatgtccgcccggtgatggtcgggctccggcgggacgggttggtggaaatcaccggcggcctgtccgcgggcgaaatggtggctctgaaggccggcggcttcctgaaggatcgggagaaggttcaccccgtgattgccggcacggatgctgcgccgaaagacgagctggccgtatcacccccgacggacgatgcacgggggcgcatgcgcgaatgaatacaaatatctccgcatgggccatacgcacgccgctgccgtccattctgctgttcgtggttctgaccatcatcgggctctacagctttgtacgcctgccgatcacgtattttccaacggtcatcacgccgtcggtccgcgtcaccattgaacaggcaggtgcatctcccgcagaacttgaaatccaggtgacgcggcttgtggaaaacgccatagcctcgctgccagcgatccgacggctggattccatgatcgatcaggggcgttccgtgacgaccgtggaattcgaactgggtctggtgacgccggaccgtgccgtggacgatgtgcgggacgcggtctccaggatcaggagcgacctgccggccatggcagatgagcccttgatcgaaaggctggaagaggattccacatccctcgtcacctatgcagtcctgaaccccgatatgacggtgacggaactgtcctggttcatcgatgacaccgtgacccgcgctcttcagggtcttccgggtgtcgggcgtatcgagcgtgtcggcggtgccgatcgcgaaatacatgttgaactggatgtggagcggttgcaggccctgtcgctcaccgccggaacggtcaacgacatgctgctgcagacgcagcttgaacgttcgggcggccgtagtgaggtgaacggcaacgaggaggtcgtgaccacggctgccgcggccgaaacgatcaccgaactggccgggcggcgtctggcgctcgatggtgaaagctcggtccggctttcagacattgcacgggtccgcgatgcgaatgccgagccccgggccttcgccatgctcgacggttccgagatcgcaggcttttccgtctatcgctcgggcggagcgggcgaagtggccgtcgctaccgctgtcgcgggcgcgcttgaggagatcaggaccgcttatccggacctgcagttccgcctggtcgacgacaatgtgtcctataccgtcggcaactaccatgcggccatgagcagcctgttcgagggggcggccctgtcggtcatcgtggtgtttctgttcctgcgtgactggcgggcaaccatcgtcgcggccgtggccctgccactttcgatcatcccgacgttctttgtgatcgggcagctcgggttctcgctgaacattctcagcatgcttgcgatcacgctggtgaccggcatcctggtcgatgacgccatcgtcgagatcgagaatgtcgtgcgccatcgcaacatgggcaagtcggcccgccgtgccgcgctggatgcctccgacgagatagggctcgccgtcatcgcgatatcggcgacgatcatcgcggtatttgcgccggtcgggctcatgagcggcgaggtcgggctctatttccgtgaattcgggctgaccgtcgccattgccgtcttcttctcgctgctcgtctcacggctgatcgtgcccgtactggcggcgtatttcatgaccgcggggcccccgaaggatgaggaaaacgggcggctgatgcggtcttacgaatacctgctgaagatgagcctcaggcaccccctgctgaccgtcggcacggctctggggctgttcgcgatcgcgatcgtgtcgttggcgtcgctgcccaccgcctttctgcccgaagaagacatggggcgactgacgcttacggtcgaactgccgccgggcgccaccctcgacgacacccgggcggcaaccgatgacattgcggaccgccttcgcggtttcgaagaggttcggggcgttttcgtccgcgccggggcgagcatgaccgggcaggaggatgtgcgtcacgcgatcgtgctgatcaatctcgttcacaaatcgcagcgcgagaggtcattgtcggcgatcgaggccgatctggaaagaatgctggcagcgtttccggatctgcgtctgcgcttcctcaacaatcggggcagtcgtgacgtttcctttgcgctgctgggcagcgacggcgatgccgttcaggcggcggcgaatgccgtcctgcgtgagatgtcggccgatggcgacttcgtcgacccgtccagcgacaacatcgccatgcgcccggaattgcgggtgatcgtcgacaccgacagggccgcgatgctcggcgtgtcgccggcgatgatcgccgagaccatccgcgtgtccaccatcggcgaggtcgacagcaggctggcggattttctcgacgggtccagaaagatcccgatccgggtcatcatcgatccggttttccgggggaatctgccggccttgcagttgttgacccttccggcagccggcggcggtcaggtcccgttgtcggcggtggccgggatccgtttcgacgaaacggctgccgtgatcaatcgcatggaccgtctgcgtcagatcgagatgggaacggacatggccgcaggcatgacctcggggcagggtctcgaaaagctgatgacgctcgacagcgtccgcaacctccccgatggcatacacatacggacaacgggcgattccgacagcgagggcgatgtctttgaaagcttcgtgcccgccatgggcgcggggatcctgctggtcctgatcgtcctgattctgctgttcggcagcgtgcttgcgccgtggacgatccttgcgtcgctgcctctctcgattgccggggtcaccctcgggcttgtgctgggcgggcatgccgtgtccctgccggtcgtcatcggcattctgatgctgatgggcatcgtgacgaagaacgcgatcatgctggttgatttcgccatcgaacgcgaggcgcaggggcttggccggatggaggccatcgtcgaggcgtgctccagccgcatccgcccgatcgtcatgaccacgctggccatggtcggcggcatgatcccgtcggcgatcggcattggcgacggcggcgagttccgggccccgatggccatcgccgtcatcggtgggcttctggtgtccacccttctgtccctgatcgtgatcccgtcgctgcacctgatcatgtcgactctgggtgaccgcctgacctggattttccggcgggtttttcagtcggccgggggctagagcctgcgtcaggcaggctcgttggtgtggccggtttcccctgacacccacttctccatcaccacccgcggcaccgcctgataccccaccttttcataaaacgccttcaccgccgtattcgtctcgcggatcatcagcagcaccttgcgcacgccgtggcggcgcagccagtcttcgccggcggtgacgatgtcggtgccgaggccctgctggcggcaggtcgggtcgacggcgacgtaatagagccagccgcggtggccgtcatggccggccatgaccgaggcgaccagccggccgtcgagccggcccgccagcacctcggaatgggagcggccgcgcgcgaaggcgatgtcgtccagcggtacgactgatcaaggctggcatccgggtggagcggatcgagcccggtaagccgcaacagaacgggcgacatgagcggatgcatctgacgcttcaggaagaaacggcctcgccgccggcccggagcctgaaggagcagatgcagcggttccgggacttccgccagagcttcaaccacgagcgcccgcatgaagcgctggattatgaggtacccgccgcgcgctaccagccctcgccacggcgttttgacggccggctgcgatcgccggactatccgcatgacgccgagatccggagagtgcgcaggaccggagagatcaaatggcgaaaccgaaacctgtttctgaccgaggtgctctcaggcgagccggtcgggctgttcctgatcggccccgagacctggctggtgaaatacgggcctgttgcgctgggctcgatcagggggaaagcgggctttgaaaagtttggtgcgggatcgtgatcccgcaccaaaccaaggccggaaccggggtgagctgttacctatgtcgccggtctgaagtgttacccgtctttccggttgctcagggccgcagcatgatttgagatccgtgcgtatcggggcaaaaccggcgccagatgaccggttatctgcgcgccaagccaacacgctatcttcccttctgggcgggcgagacatcacccctcaggatctgaagtcgaaacaaaagcctccgaaggttgacgaggtgtcttctaactgctaatgattctcattatcaaaatggagcggagaatgtctgataaccatctggagcaaagcggatgaaacccggcacagccgaggcggcactgcgcgtctgcatgatcgggctccccgccacctgcgccgttttcggcggcagcatcatccttgaccatctggctgatcttggcaggcccgaatggcagcaggcgctcgtctccatcactgcaggggctgtaatcggtggagtcgtgggattcctattggtgattgtgaagaaatttatgatcaaggactaatcgtatgatcaccagagattatgggctgcatcgacttcatatttgtatggcattattattggcggcgatattcatatcaatttccaattcatctgaagcctcgcaaatttcgaagaactcggcaaaagagaataggaatattgttgaaatagaagattttttgccgggtacgggagatgtcacagtctcaataggggcagatttttcttatttgaaccaggactcgaacacgttcgcattcgggcttgcgccacaaggtaacgtgataacactcgtccccttctcagttccgtcaaatcgccagacttattcgttttccgccgcagcagcagtgacctatggaatcaccgaaagattatcactcggggcacgcatacgaggaacggccgagtttactgagatccagacaggcggccactacacaaaaagagacgataaatatgaaatatctgacatttccctaactggaaattacaaaattacacccatcacagagagtccttattattatatatttggagaatatcgatttctggaaatggaagatgatgtatctatcggtcactcttatgcctttggcgcaggcatcggatggctggaagatcctattctcatttctctgggactcgccttctcctcggtggatgtccgagatccagaatcttctctgaatttctctgggcggtacatgatggcatttccagcaatagccttctctgtcaacgaaaagatcaatctgacgtccggtgtgagccttgggtacatgctcgacgacatgccacacggcgcaggaggatcatcgtttagcagcgccatggccttcgggctctcctaccgcatgagccgccagacggcgttgaatctcaacacccgttttggcttggcggataacgagagtgtcggcatgcatggcacgtggatttataggttctgaaaggagaatagcatgaggaagctacgggcaatctctggaatagtggtcctgttgtcgatcatgatccacccggcatttgcgttggaacaagatcagtcagcaaaaatatttggaccgaaacaccgagaactctacactcgcgaattaacagaagaagagcgtaaaaacataacaggagcgatccacccagtcattatagcggtcgggtgggccgcgggcgccggaggggcaagcatcgtctatcagtatgccgccaatggtcaggtcgactggtgggaagtagccaccaacgctacgggggccttcgtcggagcacttaccggcggagccctgactccgtatatcggacaagtcggctccgccgtagtaggcggagcagcaggaatgatatcttattatggaatgaataatcatatgaacatcggttctgtgtgctccacatgccaccagtgattgcggacgagatgatcagatattacgctttatcggttctggtattttctgtgcccacagatgttttggcacaggaagccacatttccattttttccgggagaggtgatcaagccattcaatattcagaagtataacaaaataacgacacaagtatttgatagctcctgcggggcagcttcggttgcaaacataatcagcgaatactacaggataccgacaaatgaactggtaattctagcaaacatgaatatacatggggatagatccgagtattcatttgaagatctaagatatggggttgaatttcacaatctaacgcccgtatacgtcgcgactaattatgaggcacttctggagctcaagattccagtgatcgcacatctacgattgcttgacggtaatcacttttctgtaataagagctgtcactgaaaattacatatttttagctgatcccgcctgggggaatgtaaaattgacgcgcacacaattcgaagagaaatggttgagtgatacaaatgaaggtcatatcatggctataatttctgaaaacaacataaacacttctgatgaatatttcggtctaaaaaaatatcgataaatcaatctatatgatatttcatgattttagatgaaatatgggtatgtatttattaatacaaaatcagcttattggtagtattctgaatatctttatagatattatattgtgaatcaatccgttcaaaattgctcgtgagctagaaattcatgcgtaatttcttccatcatgttctattctatattccgcaaactgtcgtgcacattctaaatataatcatgcccgactcactcctgcatcgagaagcatgtcttcgatggcgcaactccgagatgttgtcaccgccttcaaggcacgccgacacgaaacacaacctctcatccatcacacaggtctcttgccacgccatggtcgcacctccgcgaccatcttgcacacctgtcacccatgtcagcgggctgaactgttacctatctaagcggtctggaccgaccggtctggccccccctcacaaccacctctccatcaccacccgcggcaccgcgttataccccaccttttcataaaacgccttcaccgccgtattcgtctcgcggatcatcagcagtaccttgcgcacgccgtggcggcgcagccagtcttcgccggcggtgacgatgtcggtgccgaggccctgctggcggcaggtcgggtcgacggcgacgtaatagagccagccgcggtggccgtcatggccggccatgaccgaggcgaccggccggccgtccagccgcccgaccagcacctcggaatgcgaacggccgcgggcgaaggcgatgtcgtccagcgggtcgttatagggcatcaccagattgcaggcctgccacagcgccaccagcgccggcagttcggcatcgtggacggggcccaccgtcaggcggggccggtcgggccggtcgtcgggatcggtggcatcggtgctgtccatcggcgtggtcctttcgttgcggggcggcgtgcgggccatgcggtttcgtggccgcagatcagcagagatccatgaccacagaatgacaaaaccgcagcgccaggggccagcctgtggagcagccgcttgactcgtcggtaaccagctattacggatggaaaacccatgagtttttctttcggccaatccggtttccgtatgcgtcaccccctatgccgggtggcgtgacgtccggggccgggtcggagggaaagccggggcaagcccggcggcggaatcagaccgggcggaaccgaacgggaggaagcccatgtcgatggatgtcgcgggccccgccatcagggcggtgccggcatgacgggcgaggtgcgggcaccggccgggggcctgctccgcctggccgatctgctgaacacggtcgtcgcccggatcgtggtctggctggtgccggtgatggtggtggtgaccatcatggatgtggcgctgcgcctgttcgccgggcgggccacgctctgggccttcgatgccacggtgcagttctacgccgcccatttcctgctgctcggcggtttcaccctgctgcgcggcggccatgtcggggtcgatatcctgcgcgagcaggcggggccgcgcaccgggctggtgatggatgtggcgtcctggatcgccttcttcttccccttcgccatcgtgatggtgctgtggagctgggatttcatgatcgcctcgtgggcgatccatgaaacctcgcccggggttgcggcgctgccggtctatccgatcaagaccctgttcttcgccggcaatctgctgctgctgatccagggcgtggcggaatttctgcgggtgctcgccggcggtttcagccggctgaagggggcgtgacgccatgcatctctcccccgaactcttcaccatcctgatgttcgccggcctgctggtcgggctgctgctcggccatccgctcgccttcgtgctgggcgggctgtcggtgatcttcgccatgctcggccccggtattcccgccttcggcatcgtgatcaaccgggtctggggcctggccgacaattacgtcatggtcgcgatcccgatcttcgtgttcatggcccggctgctcagcgacagcggcatcaccgaccggctgttccacacgttgcgtctgctgttcgggccggtgccgggcgggctgaacttcgcggtgatcatcatctcggtgctgctggccgccgccaccggcatggtcggcgcgtcgctggccgtgatgggcgtgctggccctgccggcgatgatctcttacggctatcgcaaggaaaccagcaccggcgccatcgccgccggcggcagcctgggcattctgatcccgcccagcatcatgctggtggtgatgggcggctatgcccagctgtcggtcggcaagctgttcgcggcggcgctggtgccgggcctgctgctggcggtgtgctatgcgctctataccggcatcctgtgctggatgaagccgcaatacgggcccccggtcacggccgaggaacgcgcgcagacctctaccggcgcgctgctgctgatgctgctgaaagaggtggcgcccaccctggcgctgatcctgggcgtgctcggctccatcttcaccggcatcgcgaccgtcaccgaggcggcctcgatcggtgcggccatcgccttcctgatcatcctggcctatcgccggttttcatgggcgatgctgcgcaccgcggtgatcgaaaccggcatcaccaccgccatggtcatgttcgtggcgatcggcgccaccgccttcaccgggatcttcgtcgccggcggcggcatgggggtggtgcagtccttcttcaccgggctggagatcggccgctggggcaccttcgccctgctgatgttcgcggtgttcatcgccggcatgttcctcgactggctcggcgtgatcatgatctgcttcccgatcttcctgccgatcgccgccgccctcggtttcgacaagctgtggttcgtgatgatgatcgcggtctgcctgcagacctcgttcctgacacccccggtcggctatgccctgttctacctgaagggcgtggcgccgaagggggtcaccactatgcacatctatcgcggcgtcgtgcccttcgtgctcatcatcctgggcgtgatcgggctgtgcgcgctgttccccggcatcgtcacctggctgcccacccgtgtgggctgataccggccaggccgaagaaacatcccaacgaccagacacgtccgcatgaacggacggcgcggaggaaacatcatgcccagtatcaccatatccgggatggccagggtcgccggcctctcagccggtctggcactctcagccggtctggcactcgcaaccggtaccgcccttgcggccgacgccaccatgcgcatgacaaccacctggaccagcggcatcaacctgatggagggcgacaagaaattcgtcgagatcgccaatgcgatcaccggcgatgcgctcaagatcgagttcttcgaaggcggcacgctggtcccgccgacccaggtcttcgatgcggtgcagagcaataccgtccaggcctcggccgactggccgggctattgggcgggcaagaattcggccttcggtctgctcggcagctaccccatgctgttcaccgccgccgactatatcctctggaccaagcagtggggcgggttcgaggccttccaggaagcctatggccagttcggcatggtctatctgccctatgccgtggtctcgatggaatcgggtctgcgcggccgcaacccgatcccgacgatcgccgatatggaaggcaagcgcatccgcatgtccggccgcgcccagggcgagatcctgaagcggctgggcgccgcccagacccagatcgccggcggcgaggtctatcaggcgctggagcgcggcgtggtcgatgccgccgaattctccggccccggcgtcgactggggcatggggctgcaggaggtctccaaatactggatgcccccgggctggcatcagccgggctcgatgagcggggtgatgatcaacaagaaattctgggacgggctgcccgaagaggttcagaccaagctgaagatcgccgccgacgccaccctgtcctggtcgatcgcctattacgagcatgacgcggtcgaggcggtgcgcaagttcaaggaggccgggaccgaagtcgtgcagctgccggccgaggacgtggcgaagctgcaggagatctccaaccaggctctggtcgacgaggcctgcgccaacccgctctttgcgaagatcgccgcctcgcaggtcgaatacatggcagactatgccgaatggcgcggcatggccggggatttcgccatggggcgcaatctctccaaactgcctgatgtcgcgaagctgaaatcctgcgccggctgacatcgcctccggaggctgcccgatgaccaccgacacgccgtcctctcccatccttccggaggtgaccgccgcgggcggcctcaccatcgacctgctgttcgcgcgccaggcccgcgccaccccccaggcaccggccctggccgatgccgggggcgaggtcgccttcacctatggcgcgctcttcgcccgggtgtcgcggctcgccgcctggctgaccggcccggccgggctgaggccgggcgaccgtttcgcggtactggccgaaaaccgcaccgaatatgtcgaacttctgctcgcggccgcgatgagcggcaccatcctggccgcgatcaactggcggctggcaccgcccgaggtcgcccattgcctgcgcctggtcgaacccgggctgatcgtggcgagcccccgccatgccgggctgctggatgcggcagctgtcggcgatgtgccgcatctgctcttcggcccggatttcgaggcgatcgccaccaccggcccggtgccggatctgcccgcggtgaccgggcccgaaagcgggctggtcattctctacaccagcggcaccaccggcctgcccaagggcgcgctgatcagccaccgggccgagatcgcccggacgcaggtgatggcgatcgaccatgccattccgcccgggcgcggtttcgtcgcctgggcgccgctcttccacatggtttcggccgatcaggtgctgggcacgctgatccgtggtggcaaggtgacggtggtcgacggctacgaccccgaggccatcatccgggtcgtagcgcgcgaaaagatcggctggctggtgctgatgccgggcatgatcgaggatttcctggcccatctggcggaagccgggccgatcgagcccgatgtgatggtgatgggctgcatggccgatctggtgccgctggcccagatccaggcggtgacccgggccttgaacgcgccctatctcaacagcttcgggtcgaccgagaccggcgccgcccccgcctctgccgcggtgatcggcgtgggggagctgcccgccggcctgtccaagcgccagagttccggctgtgcggtgcgcctggtcgactgggacgatacggaagtgcccgacggcatgccgggcgaggcgacgatccgctcgccctcgctgttctcgggctattggaacaatccggaggccactgccgaagactttcgcggcggttggttccatatgggcgacatgttcgtccgcaatccggatggcagcctggatttcgtcgaccggcgcaaatacctgatcaaatcgggtggtgagaacgtctatcccgccgagatcgaacggctgatcctggcgggcgccgacatccgcgaggcggtggtggtgcgtgcgcccgatgcgcgctggggcgaagtgccggtggcggtggtcgcagccgcaccccacgtaacgcgcgaagacgtgctcggccgcttgcatggccggctcgcgcggtacaagctgcccaaggcggtggtgttcctggattacgacgcctttccccgctcgaccaccggcaagatcaagcgtcacgacgtcgaaaccctgctcgacagtcggggccagctcaagggagatcccgccccatgaccaccgcatccggatccgcagctgacgtctcaaccaatggttatgtccacggcttcgccgaaggcgccgtgctgctggagcgccgcggcccggttgcctgggtgcggatgaacatggccgagaagcgcaacgccatgtcggaagcgctggtgcagggccttgcccgcgccgtcgatgcggtggaggccgacccggccttccgggtgatggtcatcaccggctcggggcctgccttctcagccggcggcgacctcgccctgtttcagcggctggtcggcagcggcacgctcgataccttcgacacatatcttgagcgcggccgggcgatgttcacccggatcgaacagttccgccgcccggtgatcgccgcggtcaacggcgtcaccgtcgcgggcgggctggagctgatgctgaccgccgatctggtctatgcggcggaaagcgcccggatcggcgacggccatgtgaagttcggcgtgatgcccggcggcggctccactgcccggctgtcgcggcggctgcccttcaatgtggcgagcgagctgctgctgaccggccgtctcgccgacccccgcgagcttgccgcccatggcctggtcaatgccgtgctggccgacgacgcgctggagacccatgtccagcaggtggccgaaaccatcgcccgccacagttccgacggtatcgcccggatcaaggccctgcatgcccgcgcccgtgaccgcagcctggacgacgcgctcgcgaccgaggtccgcgccctgctggattatgcccgcggcccggatctgctcgaagggctgaccgccttcgtcgagaagcgggcaccgcggttcaggtgagccgccgcgctctctgctacccctacgcccgatgatgccccctacgcccgatgatgcttcgggggcaggccgtaggtcttcttgaacgcggcggtgaagctggtcgggctggtatagccggcgatccaggccgcctgggcgatcggcacgccgtcgcgttcaagggccgcccgggcggcctccagccgcttcaggcggatgaattcatagaccgtcattcccagatgttccttgaaatggcgctggatcgacgaggtgctgaggcccatttcgcgggcgatgccctcgacggtcagcggccggcccagattctcaagaatatggtcgtggatgcgggcgatctgccggcggctcatctccaccggtttcggcgtatcgtcgccggtggcgtccagcatctgcaggcaggcttcgcacatcaattgcagggcgtgcgacttgcgataaagcgtgcgcaattcgccctgcatcggcaccggcggttccagaatgcgttcggcaagctggatcagcgccggccgggctcgaagctgaaccggttcagatggccggcgaagaagcggcgcagcgccggcatgccgttttcggggcagctgcgcatcagatcctgcatccagggcaggggcgctgagaccatcaccttgcgcatcgccacatcgctgtcgttcacgaagcggaccaggcagggccgggcgacgttgagcaggaagacctgcggcaccgagatgtcggaatcgccggcatccaggcggaaatgctcgccatccatcacgaaatgctgcgcgccctgcaacagcacgatgaccatgaatttcggccagacctgatgcagctcctcgtcgggcgtgcaggtcgcaaggccggtcatcgtgccgacgaacaggtcatgtggaatgcccagggcgggcgcagtttcctgcatgtgaacaccttgatcacgcttgggtcgggtcaggtgtcctcacgacgctgccatcgtgcctgcgcaggtctttgccgcttttgaagaggtcatgtcgcacgacagcgccgacaccctagccctaaacatcggaaagtcaatggacttccaccgccctggcagggggcggaggggtgttcgcgtatgtcggagaaaaacatatggcacgcatggcgtatcgggcaggcgcgggaaaatgggcgttttccgtgtcctgggcagcacttctggccgcagggccggccgtggcggaagacgcggtccggctggacgtcctgaaggttgaagaacgggcgaccgagaacggcaccggcccggtcggcggctatgtcgcccggcagagccggaccggtaccaagagcgatacgccgatcgcaaaaacgccgcagagcgtgtcggtcgtcagccgggaacagatgcaggcccagcaggtcgaaagcgtcgctgaggcgctgcgctacaccccgggtgtctttgccgaatatcgtggcgcgtccaatctgcgcgatgagatcttcgttcgcggcttctattacgtgccgaaatatctcgacgggctgttcctgggcggcgacctctcttacgccaagatcgagccctatctgctggaacgggtggaaatgcttgccggcccgtcctcggtgctctacggccaggccaatccgggcgggctggtcaacatggtcagcaagacgccgaccgatatgcccctctacgaaaccgaggtctcgatcggcaccggcaatcactacggcgccgccttcgacctgtcggaccggctgacgaccgatggccgctgggccggccggctggccgtcaccgggctcaatcgcgatcttcaggaagacggcgccgaacgccgcgccttcgcggtggcgccctcgctgcgctggaccgatcacgagaccaccagcctcaccatcctcggcggctatcagaacgagcccgatgccggctatcgcaacttcctggatgcggccggcaccatcgtgccgatcccgggctatggctatgtcccccgcgacttcttcgtctccgataccggtttcgagaagttcgagcgcgaacagctctggatcggctatcagctggagcatgcggtctcggatgcgctgaccctgcgccagaatgcccgctatcatcaggtcgagaccacgcatcataccctgatctatggcagcgccagtgccagcccgaccaccggggccgccaccatctacagtcgcagcctgaccggcggggccgacgactggcggcagttcgcgatcgacaaccaggccgaataccgcttcggcaccggtgcggcggcccataccctgctggccggcctggactatcgccaccgcacccgcgactacatctggggccgcaaccgcaatgtgccgtcgatcgatgtcgccaatccggtctatggcaatttcgacttctcctctctggacctcaccacaaccgatgatcaggatctgacggcggaacagttcgggctctatctgcaggaccagatcgagatcgacggtttcagcctgctggccggtctgcggtatgatcgcgcctcgaccgatatcgacgacaacttcaacgacctgtcctattcctacgacgacaatgcgctgacctggcgggtgggggcgctctacaccttcgataacggcatcgcgccctacgtctcgtattcgacctcgttcgaaccgtcgctttacgcccccgaagcggggcagccggccttcgaccccaccaccgcccggcaggtcgaactcggcgtcaaatacgcgcccgaggggaccggcctgctgctgaccgccgcggtctatgatctgcgccagaaggatgtggtgatgagcgcctgggatcccgacctcggccggtcggtctattcccaggtcggcgaggtccataatcaggggctggagctgtcggcgaaggctgaactggacgagcacctctcgatggtggcgagctattcctatatcgactcgaccatagaggactcggtgaccgccgccgagatcggccggacgccggcgcgggtgcctgcccataccgcgtcgctctgggccgattaccgattcaccgacggtgccgtgcaggggctgggtcttggcgcgggcgtgcgctatatcggcaccagccagggcaacaacaccaatgacttcgaggtgccggccgtgaccctgttcgatgcctcggccagctatgatttttcggccctgggcggcagctggcagggcgtgtcggtgcaggtcaacgccaagaacctgaccgacgagacctatgtcgcctcctgcgccagtgcctatgcctgcttctatggcgaagggcggacggtggtcgcgaccctgaagaagcgctggtgagccgaccgatgatccgtccgacgcgcgccgtcgtgcttcccctcctgatcctgctcgcctccccggccgccgatgcggccggggggcaggcggtcggcggtaggcttgccgccggtgagacggctctgatcgatcctgcggcggcgccgggcgattatctccgcggtcgcctcaccgtcgacggcggccgcttcgatctcgatctggtcgatggcgcaggtgtgccgctccgccatttcggcagcgacatcccgaccgtccgcagcttccaccatgtcatgggtgacacgggcgagcggttgcagatccgtgcggttgagccgggcggctggcggatcgagctggacccgccggtcccggctgccgcccaaaaggcgcctgacccggaaccgttgagcccgaccatcgcagcccttgcgcgcgatctcgcccgcggcggcgataccgccggcttctgggcggacatggccgcgcgcggcacgccgctggtcgagcccgccgaccgccccgaccggcggatcgtaaccttcctcgcccgcggtgcccggcacaacgtccggctgttcggcgggcccggcaccggccatgacgagttgcagcgtctgggcaacgccgatgtctggtatcgcagctatgttctgtcctcggacacgcggctcgcctatcagctggccccggacgtgcccgatttcgccggcacggcgcgcgaacgccgggtggcggtgctggccaccgccgcggcagatccgctcaatcaccatccctggccggccgatgcgcccgacgtctgggcacgcgattccctgctggtgctggatgatgcgccggatcagccctgggcggatgccggggcctccgtgccgcgcggccggctcgatcacctgcggctgaccagccgccgtctcggcaatacccgcgacatcaccctttaccgcccggccggtttcgatccggcgcggccggacaccgtgctgctgattctgttcgacggccgggagtatcagcggaaggtgccggtgccgcggattctggacgcgatgatcgcggccggtgccattccgccggtggtggcggtgctggtcgacagcctggaccaggacacccgcggccgcgaactgccgggccatccggatttcgccgacatgctggcggaagagctgctgccgatggtacgcgccgcggccggcttcgcccccgatccggcccgcaccgtgctttcggggtcgagcttcggcggtctggccgcgatgaccgcggcgctccgccatccggacattttcggcaatgtgctctcgatgtcgggctcgttctggtggagcccgtccggcacgcccgaaaccgggcgggaatgggtggccggccgggttgcggcggcggccatgccgccgccgctccgggtcttcctcgccgccgggatctacgagacctcgggcgatggggtgacggcgtcgatcctcgacaccaaccgccatctgcgcgatgtgctgatggcgaagggcgtctgggtgcgccaccgcgaatatgccaccggccatgactatgtcgcctggcagggggtgctctccgacgggctggtcgctctgttcgggcgcgaccagccctgaccggctcagcggccgaccggctcccagccataggctgcaccatcgctgcccggcgtcacccggccgatgccggggaaggtgatatgggccccggccaccagatagcccttcgcggcggcatccttcatggcctccagccggctccggcgggcggcgtcctggtcgacgtcgaagtcgatggtgacctcggggtcggcgaactgcacgaattcgccatgggtgatgtcgccccagaccaccagcgtctcaccctgatcgctgaccacgatcgaggaatggcccggggtgtggccggcgcgcaggatcgactgcagccccggcaccgggtcggcgccatcggcgaaggtcgcaaaacggccggtctcgcgatagggggccgtcatggcgaccgcctcgtcgaagccgcgccgggcggcctcgggggcggcggcgcgggccttctcgctcagccagtaggcggcatcgcgttcggccacatgcagccgcgccttcgggaacacggccttgccgttgcgggtcagcccgcccgaatggtcggcatggatatgggtcagcacgatgtcgtcgatctcgtccggcgtatggcccgccgccttcaggctttcaggcagatggccgagcttcggccccagcaggtcgccggtgccggtatcgatcagcaccagccggccatcgggcatggcgaccagataggtgttcaccgccagcgtcaccggcgactgcttgccggcgcgggccagtgccgcttcgatctggggcttgggttcgccgcgcatgatatcggccagcggcaccgggatctgaccgtcggacagggcggtgacgccgatccggccgatgtcgatgtgatagggggcggagagcgggtcatccgcagcggcggggccggcgaggaccgaaaggccgagcaggctggcgaaagcgagcgaggcggcgaggggggtcttcgacatgggaagaggtctccgtgatcatcgggacgggcttgccccggacgccgcttcaggtatctatggtcaggtcagcaatcaaatcgatgcggatcatggagactatcgatcatttcaatctgcgcgccttcgacctcaacctgctggtcgccttcgacgcactgatggaagagggcagcgtcacccgggcggcccggcggctgaagatcggccagccggcgatgagccatgcgctgtcgaccctgcgcatgctgctggatgacgaactgttcgtgcgggtggggcaggcgatgcagcccaccgcacgtgccgtcgccgtggccggcccggtacgcacggcgctgatgcaggcccaggcggcgctgggggcgcgggaaagcttccgccccgaaaccgaacgccgcatcttccgcctgggcatgtcgagcgagctggaactgctgcttctgcccgcgctcacctcgcgtctggcgacggaggcgcctggcatccgcctgcatgcccgcatggcgccgtccacccaggtcgagacgatgatcgacaccggcgtgatcgatcttgcggtcggctgctcgctggagccggccagccggcatcgcgggctggacctcttcccggccggggtgtcgtgctgcttcaacccgcagcgcctggcgctggatgtgccggtcgggctggatgactatctggccggccgtcatgccgtcatctcgcaaagcgagagcctgcatggctgcgtgcacgaggcgctggagcggatccgcaccgatctcgacgtggtgatggcggcgccggatttcctgaccgtgctgtcggccgcggtcgaggcgccggtgatcgccaccatctcgacccgcgttgcccggcgcttcgccccgccgctgggcctggccgtctctccggtgccgctggatctggtgttcccgccggtgcgcatggtctggccggtgcggctggatcgcgacccggcggcggcctggctgcgcgaccggatcatcgagacgctgggcctcgacgtggtgcatgatcgggcggcatgacgatgaccgtcaccggggggagacatgacgacatccttcgccgcagtcctggaccgggccacccgccatcatggcgggtccggcgggctggaggcccgccttgccgccacgccctgggcggctcgcacggccgacgaactgcgcgcggtgcccgacgatcgcttcctggctgaggccacccgggtgatctttcaggccggtttcgactgggcggcgatcgatcgtcgctggccggagttcgaggcggcattcgaaggctttgaccctgcccgctggtcgctgatgtcggatgacgatctcgaccggctgatggcggcgcccggcatcgtgcgcaacgccgccaagctgcgctcggtcggcggcaatgccgccttcttctccgatgtcgcccgcagccatggctcggtcgcggcctggatcctgaccttcccggccgggcgctatatggagctggtgcgcgagctgaaaacgcgcggcgaccgtctgggcggcaagaccggccagctgctgctgcgccggatgggcgtgccctcgctcatctgctccgatgacgtggtcaaggcgctgatcacggcggatgtggtttcgaaagcgccgtcatcggcgaaggacttcgccgcggtccagggtgccctggaccgctggcaggcggaaaccggcttcgatctcacccggatcagccgcattctggcgttgtcggtgggctgatctcccggcgcttcatgtgccgccgacgatcgccggccggaccagtgccgccagcgccgatcgcatcgcctgggggtcggtcacccggcgcgggaagcggatgcgcagatccccgtcgggggaggtgaggtcgataccctcgggatcgatgcccgccgcgcgccagcgtccggcatcgccgccgccatgcagccgggccaggcgcccgggcaggtcctcgccccaggggccgttcagccgctccacctcgtcggcctcggcggcgagcagggcctcggcgccggcaagatcggtcaggaaatgcgccacctgcggctcgcccgcattgcgccgcggtccgccggcgacgcgcagatccgccatctccagccggtagaggccgatatccggcagggtcatatagagcttcgtcttcggatgccgggccagatagcgccggcggaccgcttccagccttgccggatcggttacctgcaccacccgtccgacgatggtcatccgcacccccgccagcacatcggtaagccccggctcgaccagggtcagcgacgcgcgcggatcggccgccagattgcgggcatgcagcgccagcccggccatgatgaagaccgggctaccgtcgtgatcggtcgccagattggtggcggcgccatagggatagccgctttccgggtcgagcgtcgacagggtgccgaaccgcgcggtgcgcaacagccgccggccgtgatcttcggcatcgaagggcagggcggcatccaggcgcagctcccggccgcgcggggtgatgacgggggcgccgtcggtcggcgtgtcgacagagggggcgggcgtggtcatggcggtctctccgggctggcggtcgcgcagccgaaggatgggcgtccttttatgagaatgcaagtcaatcgcaataaaggagccatgtgcggccgccgcatcttttccgccacccggcctttccaggcgcgaggccgtaccgtagcatccaagcccgaaaacaggccctcgcggccgtctcttatgtgccagtatcttatgtgccagtacgaggaagaccgatggccgatccgaagcccactgcactgcccgagcgccggcgcggctctggtgtcaagatggtctatgaccttctgcgcgatgaaattctcgatctgaaactggcaccgggcagcacggtcgacgaggcgcagctggccgagcggttcaagatgtcgcgcacgccgatccgcgaggcgctggtccgccttgccggtgaggggttgatcgagacgctgccgaaccgctcgaccatggtgtcgaacatcgattttctcaacctcagcaccttcttcgatgccctggtgctgatgtaccgggtcaccacgcggctggccgcgcagaaccatcggccggaagatctgccggtcatccgccgtcatcaccaggattacgcggccgccgtcgaggcgcgcgacgcgctggcgatgatcgcgaccaacgccgccttccacgccgccatcgccgaggccggccgcaacccctatttcaccagccttttcataaggttgctgagcgaggggcggcgcattctccggctttattaccggtcctatgaggagcagtttccccagcgcttcgtggacgaacacgccgagatgatcgccacgatcgaagcgcgcgacgtggagcgggccgaccagctgggcaaggctcatgccgagcagatcgtggcccaggtgcagaagctgttcacccgcaatggcgggctcgacatcccgctctgagtttgcattttctttgtcgacaataaaaatgcaaactgccatcatgaccatggcagagggggaggacagctgcgtcctgccggcggactgccgatcgaacggctggaaggaaacgaaggtgaaggcgacgattttctccggtgtgatccccgccctgatgaccccctgcaagcccgaccggactccggatttcgctgcgctggtccgcaaagcttgggagttgatcgatgccggcatgtcggcggtggtctattgcggctccatgggcgactggccgctgctgaccgatgcacagcgcatgcaaggcgtcgaacgtctggtggaggccgggattccggtgatcgccggcaccggcgccgtcaacacggcctctgcggttgcacacgccgcccatgcgcagaaggtgggcgcgcaggggctgatggtcattccccgcgtgctgtcgcgcggcacggtcgtcgcggcgcagcggaaccatttcaaggccattctgtccgcggcaccggatctgccggcggtgatctataacagcccctattacggcttcgccacgcgtgccgatctgttctttgccctgcgcgccgaacatcccaatctcgtcggcttcaaggaattcggcggccccgacgacatgcgttatgcggccgagaacatcaccagctgcgacgacgacgtctcgttgatgatcggcgtcgatacctgcgtgttccacggcttcgtgaattgcggtgccaccggtgccatcactggcatcggctgtgtactgccgaaggaagtgctgcacctcagcaacctcgcccaggcggcggcgaagggggatgccgatgcccgacagcgcgcgctggaactggaatcggcgctgggcgtgctctcctccttcgatgcggggccggacctcgttctgtatttcaagtacatgatggtcctgaagggcgacggcgaatacgcgctgcacttcaacgaaaccgacgaactcaccgaaagccagcgcggctacgtcaccacccagctgaaactgttcgacacctggtatgcggaatggagccggcttccgggggccgtgcagacatacaaggcgtaaggcagagccgtccggcctgcaaacggccctccctccggagggccttttttatggacctgtcgccaccggcacacggtccgcgcgcctgtgcagcccatccggtgatgcggcacaagtgcctgttctgccagtcagattttttctcgaagcttatatattttttgtatttttcttgtatcctgaatagggggttttcgccgttcggcgtgggaggggccttcgccggcgaggatcactgctgatgggagacaacagtgaacaaggcttcaattttcgctgtcggactgatggccgctaccgtcctggggggcacggcgcatgcggacaagctggacgacatcatcggctcgggcacgctgcgctgtgcggtggtgctggacttcccgccgatggggtcgcgcgatgcgaacaacacgccgatcggcttcgacgtcgactattgcaacgatctggcgaaggcgctgggcgtgaccgccgagatcgtcgagacgccgttccctgagcggattccggcgctgatgtcgggccgtgtcgatgtcggcgtcgcctcgacctcggatacgctggaacgggcgaagaccgtgggcatgaccatcccctatttcgccttcgagatggtggtcaccgcgaacggcaaatccggcgtgacgtcctatgacggcatgaagggcaaggtggtgggcgccaccgccggcacctacgaggcgatcgcgctggagaaccaggtgaaggcctggggcgaggggtccttccggccctatcagacccaggccgatgttttcctggcgctggcccagggccagatcgacgccacggtttccacctcgacggtggcacaggcgaatgtgaaatcgggcaagttcgccgggctgtcggtggtcggcagcgcgcccttcgacaccgattacgtcgcgctgttcaccaaccgcgaggaatacggcctgatcaactacctgaacctgttcatcaatcaacaggtccgcaccggccgctatgccgacctctacgaaaaatgggtgggcggcacggcgccggatctcaccgtcggcagcgtctatcgctgattgacccggcccggccgtggcggccggcagatgccggcgccacggcttccgtcaggaatgtgacctgcctcgggtccgggagacggggatgttcacctatactttccactggaatcaagcgcttaaagcgctgccgcagatgctcgacggcgcgctggtcacccttcagatcgccgtgctgtcgatggcgatcggtctggtctgtgccatcgcgctgacggcctttcgcctgtcgggcaaccggtcgctgtcggcggtggcggcggtctgggtcgagattgcccgcaacacgccggcgctgtttcagatctatatggcgcatttcggcctgggcaatttcggcatccatctcagcccctatgcggcacttctggccggcatcgccttcaacaatgcgggctatctggccgagaatttccgcggtgcgctgaaggcgatccccgatacccagacccgcaccggccgttccctgggcatgacccggctgcagaccttccgcttcatcgtgctgccgcagatgctgcgcatcggctatctgcctgcgaccaatcagatgatctgggcgatcctgatgacctcgctgggcgtcacggtcgggatgaacaccgatctggccggcgtgacccaggatctgaacgcgcgatccttccggaccttcgaattcttcgccatcgccgcggtgatctactacctgatcgccaaactcgtgaccctggccgcgcgggcgctcgcctggcgtctgttccgctactaggagggccggagatgttcgataccgccctgacctggaacgatctggccttcctcggccagggggccctgatgaccctggccgtgaccgccgtctccgtggccgcgggcacggcgatggggatcgtcttcggcgtgatccgctttcaggccggaccggtctggtccctgccgctgatgttcttcctcgacatcttccggtcggtgccgctgctgatccagctggtgctgggcaatgccctgcagtcgatcgcaaagctgggctggccgccgttcaccacctcctgcgtggtgctgtcgctctataccgccgcctattgtaccgagatcgtccgcggtggcatcgcggccgtgcccgtcaccacccgccgcgccagccggtcgctggggatgacctggtggcaggatatgcgccacatcgtggcgccgctggcggtgcgggtgtcgatcccggcctggatcgggctcacgctcggcgtcatgaaggattcggcgctggtgctgtggcttgggctgatcgaactgctgcgcgcctcgcagatcctggtgacccgcctgcaggagccgctgttcatcctgctgatctgcggcgtcatctacttcatcataagcttcccgattgcccggctcggcggctatctcgaaagacggtggtccccctatgattgagatcgaaaacgtccggaagtccttcggcagtctggaggtgctgaagggcatcgacctcaccgtcgagaagggcgaggtggtgacgatcatcggcgggtcgggctcgggcaaatccacccttctcgcctgcatcaatggtctggagccgatcaatgcgggcgtgatccgcatcgacggcacccgggttcatgaccggacgacggatctgaaccggctgcgccgcaaggtcggcatcgtcttccagcaatggaacgccttcccgcatctgacggtgctggagaatgtgatgctggcgccgcgcaaggttctgggcctgtcccggcagcaggccgaagagatcgcggtccggcagctcacccatgtcgggctcggggaaaagctgtcggtctatccgaaccgcatgtccggcgggcagcagcagcgcatggccattgcccgcgcgctggccatgtcgcccgaatacatgctgttcgacgaggtgacctcggcgctcgatcccatgctggtcggcgaggtgctcgacacgctcaagatgctggccgaagaggggatgacgatgatctgcgtgacccacgagatggggtttgcgcgcgacgtctcggatcgggtcgccttcttccatcagggggcgatggcggagatcggcccgcccgatcagatcttcggcgcgccccggcagcccgaaacccaggcctttctggggagtgtgcgctgatgaccgggccggaggtcgtcgtcatcggggcgggggtgatcggcctgtcggcggcgattgccgttcagtcgcgaggctttccggtcacggtgctcgaccgcgaggggccggcggccggtgcctcggccggcaatgccggcgccttcgccttcaccgacattctgccgctcgcctcgcccggcatcctgcgcaaggcgcccggatggctgctcgacccgctcgggccgctgtcggtgccgccggcctacgcgctcaagatcgcgccctggatgtaccgtttctggcgggcctgcgcgcccgagcgcgttgccgccgccaccgatgcccaggcggccctgatggatctctcccgcgccgagctggaacccttcctgcaacagaccggcacgcgcggcatgttgcgcaaggacggcaatctccaggtctatgaaagccgcgcggaattcgaggccgcgcggcccggctgggcggcacgcgaacggcacggcatcgatttccgccatgtcgatccctcagagatggccgcgatccagccggggctctcgtcgcgcttcacccatggaaccttcacccccggctggtactccatcgccgacccccggctctacaccctggcgcttgccgatcatctccggcagcggggcggcaggatcgagcgggccgaggtcaccgcactccggcccgaggcagcgggtgtcgggatcgtcacggccgacgggacgtcgcggcgcgcggcccgggtggtgcttgccgccggcgccttctcgcaccgcatcgcccgcaccctcggcgacgccatcccgcttgaaaccgagcgcggctacaacaccaccctgccgcccggtgccttcgatctcagaacccagatcaccttcggcgggcatgggttcgtgatcagccgcctgtccaccggcatccgcgtcggcggtgcggtcgaactcggcgggctggatctgccgccggattaccggcggtcgcgggccatgctcggcaaggcgcaggcatttctccccgggctcgtcgcaaaagggggcgtcgaatggatgggcttccggccgtccttgcccgacagcctgctggcgatcggccgggccggcagccaaccgcgcgtgatctatgccttcggccacggccatctcggcctcacccaatcggccgggaccgcccggctggtcgccgacctgctgaccgacgaaccatcgcccatcgatctctcgcccttttcgcctcaccgcttctgacagagtgaacgccatggcctgcttcacattctcgtgcatcgacgggcatacctgcggcaacccggtccgcctggtctcgggcggcggcccgcgtcttgagggcgcgaccatgcttgaaaagcgggcgcatttcgtcagggagtacgactggatccgcaccgggctgatgtacgagccgcgcggccacgacatgatgtcgggtgcgatcctctacccgccgacccggccggattgcgatgtcgcggtgctgttcatcgaaacctcgggctgcttgcccatgtgtggccatgggacgatcggcaccatcaccatgggcgtagagaacggcctgatcacgccgcgggcgccgggcaggctgtcgatcgatgccccggccggtaaggtcgacatcacctaccggcaggaagggcgtttcgtcgaagaggtgcggctgaccaatgtcccggccttcctctatgccgaaggcctgaccgtcgaggtcgaggggctgggcgaggtggtggtcgacattgcttatggcggcaatttctacgccatcgtcgagccgcagacggccttccgcgacatcgccgatcacaccgccggagagctgatcggttggagcccgaagctcagggccgcgctcaacgagaagtacgaggtcgtccatccggagcatcccgagatccgcggcctcagccacatcctgtggaccggggcgtcgacgcagccgggggcccatgcgcgcaacgccgtcttctacggcgaaaaggccatcgaccgctcgccctgcggcaccggcacctcggcgcggatggcgcagcttgcggccaagggaaagctgaaggtcggcgacgatttcgtccatgaatcgatcatcggctcgctgttcaacggccgggtggaagcggcggccacggttgccggacgtgatgccatcatcccctcgatcgccggctgggcgcgcatgaccggcatcaacacgatcttcatcgatgaccgcgatccctttgcgcatggcttcgtcgtcaggtgacggggatgggggcaggagtgcgtctgcgattgaggatgaacctctcggcctgaagacaaggaagctgactgatggtgaaacccgcatccagggccggggcgcgcccgcctgtgcgctccgctgtagtcagggcgatcgtggctgcctcggaaggcgtgctcgtggctgagaaggtgctggtggcgatgctgatggcattgcttcttggcctgatccttctgaacgtcggcacccgctatgcgggatcgtcgctctactgggtcgacgaggctgcggtctatgcaatggtctggctgaccttcatcggcgggtcggccctgacccggctgcggctcgatttcgccatgaccctggtcagcgacaggctgtcggcggcgaatgcgacacggctgaaggcgttcgcccatgtcatcgcctgtctgttttcgctcggcctcgcggtcatgtgctggaactggatggatccgccaggtattgcggcggccggtttcgatgcgcggagctatgccggcgacagcttcaatttcctctacaccgaatacacccagacgctcgaatggccggtatggatgatcagcctggttattccgatcttctccgtgaccatgaccctccatacgctggccaatatcgtggaggaaatcgggctgtcgccgaagagactgcaccccggcttcggttcggcggaaggggtcaattgagatgatcacatccgcggcctttcttctcgtcatgctcgtcggcgtccccatcgggctgtgcctgtgcattgccgccgccgtctatatctgggccagcggcgacacgctgctgtttcagacttttccggcacagctcttcggcggcgtcgacaattacggtctgatttcgatcccgctgttcgtcttcatcggcgaggtgatgaatggcggcgggatcacgcgacgcatcatcaacatgacgatggcgctgatcggggcgatgaagggcggcctcgcctatgtgaacctgatcgccaacatgttcgtctcctcgatcctgggctcggccacggcccaggtcgccatcatggcgcagatgatggtgccggagatggaaaagaccggctatgacaagaccttcgccgcggggctgaccgcctatgccggcatgctcgggccgatcattccgccgtcgatcatgttcgtcgtctattcggttctggcgcaggtgccggtgggcgacatgctggcggccggtatggtgccgggcattctgctcaccatcatcttctgcaccgtcatcgccggcatgggctggttcgtctacgactatccgagaggcgagcgtctcacggtccgcgcgcggctgcggattatcctcggcgccctgccgacgctctcgatccccatcgtcatcgtggggtcgatcctgtccggcatcgccaacccgaccgaagcggcggccgtcggcgcggtcgcggcggtgctggtcgggcggttctggatcggcgaactctccgtcgctcagctgccgcggatgctgctgcgtgccggcatctattcggcggtcgtgctgatgctggtcgctgcggctgcggttttctcgtgggtgctcgtctacggcatggtgccgcagcgcgtggcggcatgggtgcagacgatcgccaccgacccgatcaccttcatgctgctcgtcaacgtcatcctgctggtcatcggcacggtcatcgacggcgcgccgggactgatcatgacggtgccgatccttctgccgatcgcgaccgggatctatggcatcgatccggtccatttcggcgtggtcgtcgtcatcaatctcgtgctgggtttcctgtccccgcccgtcggtctcagcttcttcgtcgcctcggcagtcacgggggcgaagcccggccggatgttcgtcgtgacactgcccttcttcttcgcggcttgcagcctgctgatcctgctgtcgatcttccccgcaatctccaccgccttcgtcaagtaaccgccgccccatcatgcctccagaggacagacccatgacgatctcgcgcaggacattcctccgtaacacgacgcttgcggctgccggtgcggcctcggtcggcacgctgtttgcgcccaacatcctgcgggcgcaggaggcgaagaccttccgtctcggcatcacgacgccgcccggccatccgtggaacaatgcggccctgaaggtcggggagatgctgaaggccgaaacgaagggccgcctggatcttgccgtcttccccgcaaatcagctgggcacggaagcggtgatgttgcagcagatgcaggccggctcgctcgatttcggctggatcatgacggcggaactcggctcccgcatcccgtcgatcgccgcgatcaacgcgccctatatcgtcgattccaccgccaaggtggcgaagctggtacgcgatcccctggtgatgaagatgctggacgtcctgccgagggaaaccggcacgctggggctggcctggggcatcaccaccatgcgtgtcgtgttctcggccagggaaatcggcgggctcgacgatctgaagggcatgaagctgcggatcaacaccacccctgcctatcgcgatttctatcagctgctcggcgccgcgccgacaccgatcccgacgccgcaggtgtttgatgccatgtccaacggccaggtggacgggcttgaggccgatctcgatttctcgtggaaccagcgcttcgacaaagtgtcgaagaccatgctgaagatgaacgccatcttcatgccctgtgtcgcgctcgcctccggccgggtctggaaggatgtcccggcttccgaccgtgagcttgtcacccggctgacgcgcgaggcgctcgacgcccagatcgatgccaccgtcgccaacgaggcgcggctgctcgaagagttccggaaggtcatcacggtgaaggacgtccaggtcgcggatgccggcaaggtcattgccgagtacgatcagatctggctgccgaaggccccggttctggccgatctgcgcgcgctcggcgccacgctctgacgcgccggccccagccatcggcccagggcgtcagccacaaaataaagggggccacccttccggatggccccctctccgtcacacccccttcccccgaaggcgatgcatcggtccggcggtcacgcgcgcatcactgcttcgcgttggcgtccgcccagctcttcaccagctggtcgtaatcgaccgtctggggcttttccttctcgttctcgatcttcagctgcggcgcgatggtgccgttcttcttcgcctgctcgttccagtaggcgaggtcatgttcggggttcagcttggggccgaactcaccctgcacgccggcgcgctccaggcggctcatgaccttctcctgctcggcgcagagcgaatccatggcagcctgggcggtcttggcgcccgaggacgcatcgccgatcgcctgccaccacagctgggccagcttcggatagtcgggcacgttggtgccggtcggcgtccactgcacccgggccggcgagcggtagaactcgaccaggccgcccagttccggggcgcgcttggtgaagctctcgtggcggaccgacgaatcgcggatgaaggtcaggccgacatggctcttcttcacgtcgacggtcttcgacgtcacgaactgcgcatagagccaggcggccttggcgcggtcggtgggggtagaggtcatcagcgtccaggagccggtgtcctgatagccgagcttcatgccttccttccagtacacgccgtgcggcgagggggccatgcgccatttgggcgtgccgtcctcgttcaccaccggcagacccttcttcaccatgtcggcggtgaaggcggtgtaccagaagatctgctgggcgatatggccctgcgccggaaccgggcccgattccgagaaggtcatgccctgggcctccggcggtgcataggccttcatccagtccagatacttctggatggagtagacggccgccgggccgttggtgtcgccgccgcgggccacgcaggagccgacgggctggctgttctcgttgacgcggatgccccattcgtcgaccggaatgccgttgggcaggcccttgtcgccattgccggccatcgacagccaggcgtcggtgaagcgccagccgagcgacgggtccttcttgccgtagtccatgtggccatagaccttgcggccgtcgatctcgcggccggtgaagaactcggcaatgtcctcataggccgaccagttgaccggcacgcccagatcgtagccgtacttctgcttgaactcggccttgatcgcggggtcgctgaaccagtcgtagcggaaccagtaaaggttcgcgaactgctggtcgggcagctgatagagcttgccgtccggggcggtggtgaacgacttgcccatgaagtcgtcgatgtcgaggttcgggttggtgacgtccttgccttcgcccgccatccagtcggtcaggttgcggacctgcttgtagcgccagtgggtgccgatcagatccgagtcgttgacccaggcgtcgtagaggttctgacccgtctgcatctgggtctggatcttctcgacgacgtcaccttcctggatcaggtcgtgggtcagcttgatgccggtgatggccgagaaggccggcgccagcaccttgctttcgtattcatgggtggtgatcgtctccgagacgaccttgatctccatgccggcgaacggcttcgcggcatcgatgaaccactgcatctccttttcctggtcggcgcgcgacaggaccgactggtcgccgatctccttgtcgaggaagctcttcgcctcctccatcccggcccaggcctggccggcagccagcagcagcgccagcgccgccgtggatgccatcagatgcttccgcataagtacctccctcttgatcagctgcggatgccggcacggggcatccgtcgttcgaagcaagcctcgattggtcttcagtcacccgccgcgcagggccccgggcagtggggtcagacgaagcggaacaccaggattgcgtagatcaccgacagccccgtcgcccaccacaggctggcatccacaagccccagccagcccagatggatgaaggcgctgcccagcagcgagatgaacaggcggtcgccgcgcgtggtttcgaagcgcagcaggccgaccttcggcgccccaccgggacgggcgtattcccagacccccatgcccagcagcagacaggcgatgacgacgaagaagatgaccgtgggccaggtccaggccatccacgagaagtcgaacgacatcggtgcggcctccctcagacgcggcccagggcaaagcccttggcgatgtagttgcggacgaaccagatcacgagcgcgccggggatcagcgtcagcacgcctgcggcggcgagcaggccccagtccatgcccgaggccgagacggtccgggtcatggttgccgcgatcggcttggcatcgacggtggtcagcgtccgggccagcagcagttccacccacgagaacatgaagcagaagaaggccgccacgccgatgccgctggagatgagcggcaggaagatcttcccgaagaagcgcgggaaggaatagccgtcgatataggcggtctcgtcgatctctttgggcacgcccgacatgaagccttccaggatccacaccgccagcggcacgttgaacaggcagtgtgccagcgcgaccgcgatatgggtgtcgatcagcccgaaggccgaatagagctggaagaagggcagggcgaacacggccggcggcgccatgcggttggtcagcagccagaagaacagatgcttgtcgcccaggaaccggtagcgcgagaaagcataggcagccggcagggccaccgccaccgagaccaccatgttgatgacgacataggtgatcgagttgatgtaacccgaataccaggacggatcggtgaagatgatctcatagttccgaagcgtcggctcggccggccagagcgtcagacccgagacgatttcctcgttggtcttgaagctcatattgacgagccagtagagcggcagcatcaggaagaggatgtagagcgccggcaccagccaggaccagcgggatttcgtaccccgcttgcgcatgcggcgggccagctgctcgtcataggcgtcggtgcgggtggcgggcatggcggtcgtcgtcatgtcacgtcctcgcgtcgtaattggtcatgacggtgtagaacacccacgacagcagcaggatgatcaggaagtagaccagcgacatcgccgccgcggggcccaggtcgaactgcccgatcgccatcttcaccaggtcgatcgacatgaaggtcgtcgaattgcccgggccgccgccggtcacgacgaagggttcggtgtagatcatgaagctgtccatgaagcgcagcagcacggcgatcagcagcacgcgatgcatcttgggcagctggatgtatttgaacaccgcccagcgcgaggccccgtcgatctttgccgcctggtaataggcgtcggggatcgagaccaggccggcatagcagagcagcaccaccaggctggtccagtgccagacatccatcaccacgacggtgatccaggccgacagcggatcctgcacatagttgtaggggatgccgagcgattccagcgtgtggcccagaaggccgatatcgccgcggccgaagacctgccagatggtgccgaccacgttccacggcaccagcagcggcagggccatggtgaccaggcagaacggcacgccccagccctttttgggcatgttgagcgcgatcaggatgccgagcggcacctcgatcgccaggatcagcagcgaaaagccgaggttccggaacatcgaatcccagaagcgtggcgactgcaggatgtccttgaaccattcggtgccggcccagaagaactggttgttgccgaacgtgtcctgcaccgaataattgaccacggtcatcagcgggatcaccgccgagaaggccaccagcaccagcaccggcagcaccatgaaccaggccttgttgttccaggtcttttccatgggctcaggctcccgtgtcgacgcgccaggcgtcggcatagaggttgatgccgcgcgggtcgaaggtgatccgcgcctcggccgggatgtcgccgtcttccggcaccaccgccgcgatctcgtgcccggccagatcggcatgcacgatgcggtggcggccgatatcctcgaccttggtgatggtcgcgggcaggcccgtgcgacccaggcggacgaattccggccgcacgcccagttccagcttcgcccccggcgtcgtcgccggtgcggcaccgatgccgatcgcatgggttcccagccgcgccgttgacccgtccagcgtcacgggcagcacgttcatgccgggcgatccgatgaaatagccgacgaaggtatgggccgggcgctcgaacagctcgtccggggtgccgatctgcacgatctggccctgatacatcaccaccaccttgtcggcgaaggtcagcgcctcggtctggtcgtgggtgacgtagatcatggtgtggccgaagcgcttgtgcagctgcttcagctgggtgcgcagcatccacttcatatgcgggtcgatcacggtcagcggttcgtcgaacaggatggcgctgacatcgttgcgcaccaggccgcggcccagcgagattttctgcttcaggtcggcggtcaggccgcgcgccttctttttcgcccgatcggccaggtcgatcatctccaggatctcgcggacccgggcatcgacctcccgttcgggcacgccgcgattgcgcagcgggaaggcgaggttgtcgtagaccgtcatggtgtcgtagaccacggggaactggaacacctgggcgatgttgcgttcctcggtcgacagcccggtgacgtcgcggccgtcgaacaggatccggccttccgacgggcgcaggagccccgagatgatgttgagcagtgtggtcttgccgcagccggagggaccgagcagcgcataggcgccgccgtcatcccagcggtgatgcacttccttcagcgcgtagtcatcgtccgatttcggcgccgggccataggaatggcggatatggtcgaggtcgatcagggccatgtgttccgtcctccccggctcagaccgcttgcgcccgaagaccggcggcaagctgcaccgcgcggcccgtggcgtcgaagaacatcaggtggcgcggctccagatacaggttcagcatctcgccgatctcgtggtcatggatgccgggcgcgatcatcacccagcgctcgccggcgaaatcgacatgcacgaaactctccgagccgttgaactcggtcacgaaggcgcgcgctgcaaaggcgatcgcgtcgctgccgcccggcgccaccgtcagatgatgcggccggaagccggcggtatagcggccatcgggcagccgggtcatgccgcccggcaccgccagcgtctggccgtcggccaggcggaagaccggccccgccttggtcagcgccagcgtgttcagcggcgggtccgagaaggtggtggcggtgatcaggtcggcggggttgcggaacacctcgatcgtcgggccgaactgggtgatgcggccctcgtgcagggtggccgtattgccgcccagcagcagcgcttccgaaggttcggtggtcgcataaacgaagatcgcgcccgattcctggaagatcttgggcagttcggtgcgcagttcctcgcgcagcttgtagtccagattggccagcggctcgtcgagcagcaccagccccgccttcttcacgatcgcgcgggccagcgccgtgcgctgctgctggccgcccgacaggttcagcggctggcggtccagatagggggtcagcttcagcagctcggcggcctggcggacctcgcggtcgatggtcgcgcggtcggcaccggccagacgcatcggcgaggcgatgttgtcatagacagtcatcatcggatagttgatgaactgctggtagaccatcgcgatgttgcgcttctgcacgggcacgccggtcacgtcgcggccgtcgaaccagagcgagccgcgggtcgggcggtccagcccggccatcagccgcatcagcgtggtcttgcccgagagggtggggccgagaagcacgttcagcgtaccgcgctccagtgtaagcgtggcctcgccgatgtgggtctcgtcgcccacctgtttggaaacgcctttgagttcaagcatcgcggtgttccatgtctcgcggtcggctcgctttcgggacgatgtgggtccgggctcgggtcgtcattctgcggcggcaatgccggtgacgggcaggctgtgcatgaagtcgtccacggctgcccgctggtcttccgacagatgcaggccgcgcttggtgcgccgccacagaacatcgtcggccgtccgcgcccattcgtgggtcaccagatagcggatttcgctttcggtcagatccgcaccgaaatcgcgccccagatccgccttgcttcgcgcggatccaaggatcatccgcgcccgtgtgccatacagcctcaccagtctgcggccaaaaccgtcgtccaggaagccgtattcggcacgcagccgggcaagctcggcctcgaaaccggtggcggggaagtcgccgccgggcagggtggcggtggcggtccatgccgggccgcgggcgcccagctccgcctcgatcttctccagcgccgcctcggccaggcgccgataggtggtgatcttgccgccgaagacgttcagcatcggcgcgccgttgccgggcgcgtccggcccgtgctccaccttcagcacatagtcgcgcgtggcttcctgcgccttcgacgcgccgtcgtcataaagcggccgcacgccggaataggtccagacgatgtcctcgcgccgcactggctcggcgaaatactcgctggccgcggcacaaagatagtcgatctcgccttcggtgatccggatgtccttcgggtcgcccttgaaatcctggtcggtggtgccgatcagggtgaagtcgtcttcataggggatggcgaagatgatccggccgtcggaattctggaagaagaaggcgcgcggatcgttgaacttcgcacgcaccacgatgtggctgccctgaaccaggcggacattgtggacgtcgttgcgggccagcgtgccctgcagcacctgatcaacccaggggccggcggcattgatcagcatgcgcgcacgaaagctgcgggtcacctccggatggtcgacgctctggacggtcacgatccaaagctcgccctcgcgccgcgccgaggtcacgcggctgcggaccatcagctccacgccgcgggcggcggcatccatggcgttcagcaccaccagccgggcatcgttcacccagcagtcggaatattcgaaagcggttcggaacagcggcttcagcggtttcgcggcgggatcgctgcgaagatccagcgtccgggtcgcgggcagctgcttgcggccgccgatatggtcgtagaggaacaggcccagccgcagcagccagcgcggcctgagccccttgtgatggggcagcacgaagcgcatcggccagatgatgtgcggggcattgcgccacagcacctcgcgctccatcagcgcctcacgcaccagccggaattcataatgttccagatagcgcagcccgccatggatcagcttggtggagccggaagaggtgcccgaggcgagatcattcatctcggccagcgcgaccgaatagccgcgcccggcagcatcacgcgcgatgccgcagccgtttatgccgccgccgatgacgaaaatgtcatggaccggatcgcccgtcacccgtcttccctccccaggctttcgcaacgcagcattctctgtgccgctcgaaagtctgtgaagcgtaatgtgaaggtaatacgaatgtcaaacgaaactcgcggcgcgccggccgcgtgtgcagggcgcatggaccgcccaggggctagaacgcaagaagccccctccgcacggagcagagagggccgacgatcacggacaactcccggatctgcggatgggccggatctgcggatgggccggatctgcggatgggccggatctgcggatgggccggatctgtggaaggttgtggggagacaggcgcctatgccgcagctcggatctgcccttcgttcgtgatctggtgattgataacctcttcggaaacgccgaacttctccgccatggcgagtgcatcattgcccttgaggcgaagctctgtgatttcgttgatcggcgcgagaaattcagcggcaaaggcccggctcgccgcctgtcgatacacattgcgaagatcgttgagggacgcccgcccgttgccgggaaagcagatcacatcaccgacggcgcgggcaaaactgaacaattcagcggcagagtggccgtgacgacgcagatggatgcgtgctgtctggccgtcgactgaccgcacggctctgaggcctgcgacagaacctgcatcggagaatgcggcgctggcgccaagacgtgccgcgaggctgggcaggggcccgacctctccgctgagatccagcttcgaccgcaggatttgcgcgcggcgatagcccaatgaccatgggcgttcattgctgcgagggggcgctgatactgcaattgagtgcgcgtgagccgccagatcgtcgagccggcaggtattatccggccggctttcagctgcagagatccatgacagtagctcggtgtgtttccgggcggtggccgcgccagcgaggaactccaacagggcctcgccgctgaagaatccttccgcgttctcgatgaacgaagccgaagcgtcgtcgatctgatatgggtctaacccgaacgcgcctgcggctttgcaaaaggcagtctctgcggggtcttccaaagattggcggacgcgagcccagcgaagttgcattgccgagccggagatcctttttgatcgaagcctctgatcgacggtatcgaggaaattccggaagtggtcctctatattttgtggagtcaggatctcgctggcttctgtgaggaaggtgataccttcctgctctgacggctgaacgtgaacggtgaaggtctgtccatcgaaatcgaaacggatgtcgggcacgatatatccgctgcgccaacgcctcagtgacacgggcaggtcgtggggcgtgaagacccgccaccagtcatgcaccagcccttccgcaagagcgtacgcaacgacagttatgttcttgaccaccttgcccttcggcaggctcgccagggtcgcattacggccgccgacgtgaagggcgagcgcggccacggtcgcgcgttcctcgggaaccgcgttttccgcatcatcaatccacgcgatgtcaaacttcatcgtgctcgtcatcctgcagaggccaacctttataggtgcccagggtcgtgtttatgcagcgcccctgccaagcctttttatcgccaacgatgcgccagataaagtgggggtagatgtcgtctccttccttaaactcgtaccatcccttgataagagcttcttgtacccagcatgtggcctggtcccgctcgtccggcgtccgcatcggacagattgttgcaggcggggctttcctgtggcgggggagtccattccaccatcgcttattcttatgttccgggctgccttcatagcgggctgctccaatttcaccttgcgtcaggccacggcgacgcgggatctgtttcgggtggcgcattgtcgtctctctgtcgcaggtatgtatgccgcccgaaaatatatcatgggtagatttttgtgcttcggctaatgtgcagacaaccaaaacttgatcaccaaccccaccaccccggtaaccgccacccccgcggcccagaggcccaggaaccacagccactggcgcgggcgggggaggtggtgatggcggcgggggttgtcttgctctgccatctcaatgatacccttcatggccggtcttgccgcggaacacccaataggcataggcggtgtagcccaggatgatcgggatcagcaccgcggcgccgaccagcatgaagcccaggctcgccgcgggggcggccgcctcccagatcgtcaccgcctgcgggaccacatgcgggaagatgctgacgccgaggcctgcgaggccgagggcgaacagggccagcgccatcaggaagggcgtgtagtcgtggtcgcgcttcaggctgtagaaaaaggcggccgagcagatcagcaccagcagcggcacctgcgccgtgaacagcacccgcggccaggcgaaccaggcctcgtaataggcgcccgacaggaagggcgtcgccgcactcaccgccgccatgcagacgagcgttgcgatgcccagccggagcgccaggctgcggcattgcagctgcagcacgccgtcggtcttcatcaccagccaggtggcgcccagcagcgcatagccgatcaccaggctgacgccgaccagcaggctgaagggggtgagccagtcccaccagccgccggcatagctgcgcccctcgaccgcgatgccctggagcagcgcgccgagggtgatgccctgggccagcgtcgccacgatcgatccggcggtgaaggcgaaatcccaggcccggcgatggcgggcgtcgcgccagcggaattcgaaggcgacgccgcggaagatcagcgccagcagcatggcgatgatcggggcataaagcgccggcaggatgatcgcataggcgagcgggaaggccgccatcagcccgccgccgcccagcaccagccaggtttcgttgccgtcccagacgggggcgaccgaattcatcacccggtcgcgctggggccccggcgcgaaggccggaaacaggatgccgagccccagatcgaaaccgtccatgaccacataggcgaaaacggcgaaggcgatgacgaaggcccagatggtgggcaggtcgaagaaaccggtcatcatcggatcacctctcctcgcgggtgggtgaggcatgggtgccggggccgtgacggctaccgatcgcgcggccggcatggacggcgggtgccggcgtgatcccggcggcgcgcaccggctggtgttcctccgtctcgtcgtcgcgggtctgatcgggggtggccgtctgcggcgccttgtgcatcagcttcaggatgtagagcgtgccgctgccgaagacgatgaagtagaccaggatgaagatcagcagcgaggttgccaccgcaggtgcttccagcggcgaggcggactgcgccgtgcgcagcaggccatagacggtgaagggctggcggccgacctcggtggtcacccagccggcgatcaccgccacgaaacccgacgggcccatggccagggcaaaacggtgcagcgcgcgcgagctgtgcaaccgaccgcgcagccgctggaccagggcgaagccgcccagcgccagcatcaggaagcccagcccgaccatgatgcggaacgaccagaacacgatcggcacatagggccagtcctcgcgcggcagcgtctccagcccgtcgaggggcgcatccggatcatgcttcaggatcagcgacgacgccttggggatggcgatctggtggcgcacctcgcccgcctcctgatcgggaatgccgaacaggatcagcggcgcgccatcgggatggctttcgaaatggccctccatggccatcaccttggcgggctggtgttccagcgtgttcagcccgtgcatgtcgccggcgaagatctggatgggcgccgccaccatcaccagcccggtcgccatcgagaacatcacccgcgccgcctcgttgcggcggtcgcgcagcagatgccaggcgccgacggcgccgaccaccagcgcggtggtcagataggcggcaagcacggtgtgggccagccggtaggggaaggaggggttgaagatgatctccagccagctttccggcacgaactgcccgacctcgttgatcgagaaaccggccggagtctgcatccagctgttggccgagagaatccagaaagccgagatgaaggtgccgatcgcgaccatcaatgtcgccgcgaaatgcaggccgcgaccgacgcggttcatgccgaacagcatcacgcccaggaagcctgcctccaggaagaaggcggtcatcacctcataggccatcagcggcccgatcaccggtccggccttgtcggagaacaccgaccagttggtgccgaactggtaggacatcacgatgcccgacaccacgcccatgccgaaggcgagggcgaagatcttcagccagtatttgaacagggtgagatagaccgtgcgcccggtcttcagccacagcgcctccagcaccgccagatagctggcgaggccgatggagaaggcggggaagatgaagtggaacgacacggtgaaggcgaactggatgcgcgccaggagaacggcgtcggcctgatcaaacatagccgcctccgtcggatgatgcctggccgcgatcggcggggcggcggcgcggcagatcggtcgatgccatgacactcctcctcggaagatggtcccgggctcgaacgggcggtgagacatcgtcggaacgacgcctggaccataaggttgcccgcgacagggcgtcggcaaggtcgggtgaggcagcctgtcgcggcagcgccatccaagacccgccggcgcccatgcctcaaccgcagcaatgtcgcagccctgtcgcaggcatccgctacccggggtggagaaaaccggccggccgcgcgatgcgtcatccggtcgcgctcatgggcaactgcttgagagcatgcggtgaattcttccggcgatgccatcgcaaccttcccgccatcatgccgcagggtcggcagacatggcctttaccaaacgcgcatttgcgacgtcaggccgcgatatttttgatctggatcaaagcgcgggcacgggtttcgtgagaggctggcggttccataccaagaggtattgactcgtagccggcgccacggtacttccttgtgcaacgaacagcgacgcagggaggacgaaatgacgtcgcaggctccggtcgttcacggccgtggcgagccccggccggccttcgggtccgtgctggcggccttcgaccacgccgtcacccaacatgctgaaataacggcactcatccaccgcgggcgcagcctggattatgcggccgagggccgcgcggtggcggaactcgcaggctggatcgaggaagcgggttttggtggccgtagcgtggtgctgctgatccccaacgggatcgagtatcacatcgcatactttgcggtcttgtatgccgacgccacgccggtgctgctgaacccgctctaccccgcgccggcgctggagccgctgttcgccgatgccgagccggcgctggtgctgacggtgcccgagacggccgaggccgcccgcgcgctgatgccgcggttcggccatcaggtgctggtgctgggcgagggcgatttcacccccgaggccctggtcgcccgcgggccggcggtctgggtgcctcgccaggcctcgcccgaggcgccggccgcgctgatgttcaccggcggcaccaccggcatttccaaggcgatcgtccacagccatcgggcgatgatggatgcgatcctgcgcatcgactggggctggccgacccgcgcccggggcgaggtctggctgccggtcgcgccgatgttccacatctatggctggctgttcggggttggcaatcccgtccatgccgcggcgaccctgatcatccccgatcgcttccagcccgatcatgtcgtcgatctgatcgcgcgtcaccgcgtgacggtcttcggcggcgggccgccggcgatctaccaggggctgatggcggcgcaggatttcgagaccgccgacctctcctcgcttgtggtctgcggcggcggcggcgcgcccttcccggtggaggtgctgaagcgctggaaagaccggaccggggtcgatatcgccgaaggctatggcatgaccgagatcgcgccgatcgcggtcaataccgacagtttcggccgcaaggcgggctcggtcggcaagccggtgccggatgtcgacatccgcatcgccgatctgaacgactggtcgcgggaactaccgatgggtgaggcgggcgaggtttgcgtgcgcgggccgcacgcgctgaccgagtaccgcaatcgccccgatgagaccgcggccaccatccgcgacggctgggttctgaccggcgatatcggtttcgtcgatgccgagggcttcctgaccatcaccgaccgcaagaaagacgtgatcctggtcaagggcttcaacgtcttcccgcgcgaggtggaagaggtcatccaccagcatccggatgtgcggggcgtcggcgtggtcagcctgcccgatgcgcggtcgggtgaacggatcatcgccttcgtggtggtcgatccctataccgagaccggtgtggccgacctcatggcccattgcaaggcacggctggtcgcctacaaggtcccggccgagatccgcctgatcgaagatctgccgctgaccccggcccgcaagctggaccgcatcgcgctccgccgccaggcggcggaagcggccgaagctgcggcctgaccgccgacgatcggccatggcgcaccccatgtggtgcgccgctttctgccctcaacataccaaagagtactgtgggcatcagcaacaggggggactgtccatgaagatgcaaggtctcaaacgcgccggcctcagacttggtctcgctaccgccggcgccgtgatcgcgatgaccgcggcggccatggccgagccggtggtgctgcgctacaaccagtggttcccgaccggccattggtcgcagaccgagggtctgtatccctggttcgccgaaatcgaggcggccaccgaaggccgggtgaaggtggagccctcggccaagccgatcgcgccgccgaaccgcaattatcaggcggtggtcgacggggtcgccgatcttgcctggggcccccacggctacacacccggcgtgttcccgctgaccgaaatggtggaactgcccttcatcaccgaggatgccggcaaaagctcggtcgctttctggcggctctgggagaatttcttcgccccgaccggcatgcagggcgatgtcgtgacgctggcgatgcacgtcacctcggggggcaacatccatatgcgggagaccggggtcgaaagcctggccgacctcaaggcgcagaagattcgcgtgcccacccccaccgtcggccgggtgctgaaggatgtgggcgcggtgccggtttcgggctcgctgggtgaactgcgcgagatgctttcccgcggcatcatcgacggcacggcgatttccgacgagctggtgaccggtttcaaggtcgaacagtatgtgaagcatgtcacccgcatccccggcgggctttattccaacgccgccttcgtgatcgtcaacaaggcgaagtgggagaagatctcggaagccgaccgtgccgccatcctgaagctgtcgggtgagacgctgtcggaaaagatgggcgccctctggcataagcatgatctgatcgcgcgtgaggccatcaaggccgagctgggcgatgcctatcgcgatgccagcccggccttcctcgccgagttgaaggccgccttccagccggccgaggtggcgtggctggaacaggccgcgaagctcggcatcgacggcggcggcgcgctcaacttctaccgcgccgaactggcccgcagcgggggcaattgaggccatgaccgccctgatccgcatggtgcgcggcctgaccgaccggatcgccatggccacgctgatgctcatggccctggtcaccttcgtcgacgtcgccggccgggtgctgttcaacgagccgctgggcttcgcctacgagatgatcggcgtgctgctgggccttgccacctatgccgggctctacgccacccagctgcatcgcggccatatcgcgatcgacctgctggaggatcgctatcggcgctggccgcggttcgatgcggttcggggcgctctggtctggctggtggaggcgctgttctgggggctggtcgccgcctggatcacccgccaggccggcacctccatggcctatggcgaaaccttcctcttcctgccggttgcgaagcatgtgccgctctatgcgctggcggtgctggcctggctggcctttgccggccatctcgcccgcggctggctgaccgtcaccggccgtagcctcgcacccggggccggcaaagcggagcaggtcggatgatcgtcaccatcgccttcctgatcctgttcgcgctgctgctgctgcgcacgccgattgcggccgccaccggcctggtcggcatcggcgggctcgcggtctatcagggcatcggcccggcgctgtcgcagatcggcatcatcgcgaccgaaacggtgctcacctatgaattcgcggtcatcccgctgttcatcctgatgggcgccttcatcagccgctcgggcatcgccgaggaactctaccgggcctgccatgccctggtcggccatcgccgcggcgggctcgcggtcgccaccgtcgtcgcctgcggcggcttcggggcggtctgcggttccagcctcgccaccgcggccaccatgtcgcgggtcgcctatccgccgatgaagaaatacggctacagcgatgcgctggcctcgggctcgatcgcggccggcggcacgctcggcatcctgatcccgccctcgatcgcgctggtcttctacggcatcctcaccgagaccgatatcggccagctgttcatcgccgggcttctgccgggtgtggtcggcatcctgctctatgcggcggcggtcgtcgccgtcaccaccctcgaccgcaaggccgggcctgcggcggagcggatgccgctgcgcgatcggctgaaggcgctgcgcgatgtctgggccacggggctgctgttcgtcatcgtgatgggcggcatctatggcgggttcttctcgcccaccgaaagcgccggcatcggcgcggtcggcgccctgctgatcaccgccgcccgcggccgggccagcctggcgatggtccgcgatgcgctgaccgatgccgcccacaccaccgttgccctgatcgcgatcctgatcggcgccttcctcttcgccaatctgatcaatgtcgcaagcgttccccaggcgctggtcgcctggatcggggccatggatgtgccgccgctggtggtgatcctggcgatcatcggcgtctatctggtgctgggctgcgtgctggaaagcatgtcgatgatgctgttgaccgtgccggtgttctatcccctggtcgcgagcctcggctacgacctgatctggttcggcatcgtggtggtcgtcgtgaccgaaatcagcctgatcaccccgccgatcggcctcaacgtcttcgtgctgcgcgcggtattgcccgatgtccggctggcctcggtgttccgcggggtcatgcccttcatcaccgccgatgtcgtccgtctcgccctcatcctgttcgtgccctggctgtcgctggccctgccgcagctgatgcgctagccgacccgtcttctcccatgcccacaggcacgggactctgccttatccataccttcaggtactgaaaggaatccctgacatgaacgcccaggctcccgccgccattcaggtcgtcacccgcaccatccaggcccatgatcatcgcaccaatctgcacgaggctggccagggccgcccggtggtgctgctccacggctcgggcgccggggtttcggccgcggccaactggtcgaaggtgatcccggaactggcccgcaatttccatgtcgtcgcccccgatatcgccggcttcgggatgaccgaactcaagcccgatgcgcgctatgacatcaagctctgggtcgcgcatttcatcggcatcctggacgcgctgggcctggagaaggtcggcgtggtcggcaattccttcggcggcgcgctgggccttgccaccgcgctgtcgcatccgacccgcatcgaccggctggtgctgctcggcaccccctgcggtgaattcccgatgaccgacggcctgcgcgcccagctggagttcgacggcacgatcgagggcatgcgccacgcggtcagcttcttcccccatgacgacagcatcatcaccgacgagctgatccagcgccggttcgaggccgccacccagccgggtgcgctcgaagccttccgcaagctgatgccggcgccggccggtgacgagcggcccaccgtgcgcggcattccactcaaggcgctggcgaccctgccgcaccgtgccctgattctgcatggccgcgaagaccgggtggtgccgttcgaacgcgcgctcgacatgcaccgctcggtgccgaattcggagctgcattccttcggccagtgcggccactgggtgcagatcgagcgcgaggcccgtttcctggatctcgtcaccgaattcatggcccgcgactgatccggcgtgaaggagggccatgcccatgagccgcgacgtgctcgaaaagctgctctacgacctgtcgaccagccggcagaaccgcgaggcctttgccgccgatgccgacaaatacctcgcccgctatcggttgagcgccggggaaaaggcgctggtgcgcgactacgacgttcgcgcgctggccgatctgggcgtcaacaccatgctgacctggggcttctggctccaggccggccggcgcaaccccgactacattcgcgcgatgcaggggcgcgccatgcagggccgcgccgtgcagaaccggaacagcgccaccccgaccgaaggagccccgtcatgagccggatcgtcggcggtttcgtcgtcccccacgaccccgtgatgtatgccgcccccaaggctgcgagcgaggccgaggcggccgcggtctatggcgcctatgccgcgatcgcccgccggatcggcgagcttcaggccaccaccgccatcgtcatcggctgcgaccactacatcctgttcggcacggattgcctgccgcaatacgtcatcgcgaccggcgaggtcgacggcccaatcgaccagctgcccgggctgaagcgcggcccgatcgagaaccatagcggcctcgcccgccacatcgcggaacagggcttcgccgagggcttcgactggacggtggggcggtcgatgcaggtcgaccattcgatcgccatcccgcaccagctgctggtggcgcccaatgagggcgtgaagaccgtgccggtgatgctggcctgcggcgtcgacccctatatccacaagcgccgcgccttcgatctgggccgccagatcggccgggcgatcgaaagccatgacggcgacgagcgggtggtggtgatcggctcgggtggcatctcgcactgggtcggtaccgccgagatgggccgcatcaaccccgatttcgaccggatggtgctggattgcgtcgcccgcggcgatgccgaggcgctgattgcgctggatgacgccacgatcctggaacagggcggcaatggcgccatggaaatccgcaccttcatctgcgccatgggcgcggtgggcgccagccaggcccgggtgatcgattatctgccagtccccggctggatcaccggcctcggcttcgccgaactcgccgccgcctgaggagacgcaccccatgaccgataccaccctgatccgtctttgcgatgcggccgatcttgccgaaggcgaggtgctgaagatcgagatcgacggccgcaaaccgctggccgccaccctggtcgacggcgtggtccatgtcttcgacgacacctgcccgcatgccgaggaatcgctgtccaagggctgggtagaggatggccgggtggtctgccctgtccatttcgccgaattcgacctggccgatggcagcgtccacaacgctccggcgggctgcggaaagctccgcgcctatgcggccgaactgcgcgacggcgcggttttcgccagcctcggctgaccggtcccgatacgcgcgcctgcgccacaaaaaacacaagctctcccattcggtccgcccttcggaggaacaagtcatgtgcgacgccaaggcgcgccccgacatgcagccggtctaccccaaggccggcagctatcccgatttcgccgatctggtcgacgacagccgcgcccaggtcgatcgccgggtcttcatcgaccgcgcgatctatgaagccgagctgcggcagatcttcggccgggcctggctgttcctggcccatgaaagccagatccccaatcccggcgatttcgtgcgcacctatatgggcgaggacgacgtcatcgtcgtccgccagcgcaatggccgcatcggcgcctatctgaattcctgcccgcatcgcggcaaccgggtgtgcatggtggacagcggcaagaaggcccgcggcttcatctgcaattatcacggctggtccttcggcatcgacggccggttgaacggtaccgacggcaaggtctatgacaaggatcctggctttcagaaatccgagatcggcctgaccccggtcgctcaggtcgcgagctaccaggggctggtcttcggcaccttcgatcccgaggcgccgtcgctcgaagaatatttcgggccgttcacctggtatctcgacgtcatgctcgacaatgacgagggtggcaccgaattcatcggcggctgcgtgaagtccaccgtcgagtgcaattggaagttcccggccgagaacttcgtcggcgatatcctgcatgccttctggacccatcagtcgggtgccgaggcgattctgggcggggccgtcgatctgggctcgcgctatgacgaacgcgccttccaggccagcgtctacggccatggcatcgaaaccaatctcgacaaggtcggcaacacccgcacgctgggtttccccgagctgaacgattacgtgctgggccgctacgaggcggtaaaggcgcggctgggcgaggtcagggcgcggatggtcggcgcggtgtcgtcctgtaccgttttccccaatttctccttcctccccggccaggcgactttccgcgtctggcatcccaaggggccggaccggatcgacctctacacctggacgctggtgaacaggaatatgcccgagcggatcaaagagctttaccgcaagggcaccatgatcaccttctcgccgggtggcgtgttcgaaatggacgatggcgagaactgggaatactgcaccaaggccaatcagggctgggtgacccggcatcagaagctgcattacggcctgggccaggacagcggctgggccgagtcaagcctgcccggccatatccatcgcggctcgctcaacgacgccaatcagcgccagttctacaggcgctgggccgagttcatgcgcttcgacagctggggcgatctgcagcgcgccgagaccgcgccgccggccaaaccgatgacccgggcagccgagtgagggaggcgaggatgaccgtgcaaaccgttcccatgctcgacgaaatccccgtcgccgacgagctgctccgccgcatcgagcgcttctattaccgcgaggcgcggctgctcgaccgcgaggcctatgccgactggctgaccctgctcgaccccggcatccgctactggatgccggccatggagacccgcaaacgcggcgatcagcgcgggccctggaccgatggcgagatgtcctatttcgacgatgatttcgccatgctcagggtccgcgtcgcccgctatgaacagccctcggcctgggccgacaacccggcgacgcggcatctgcacatcgtcaccaacatcgaggcgatcgagaccggcacccccggtctggtgcgggcgttctcgtgcttcgagaacgtgcgcaatcgcaacgaaaaggaccaggacatcatccatggccgccgcgaagacctgctgaaggtcggggacgggcggatcaccatcgccgaacggcggatcctgatcgtgcagaacatcctgttgtccaagaacctcaacaccttcttctgacaaaactcatccaacctttgggaggacggcgtgatgacgggcagggccctggaaggcgaggcggcgctggtcaccggcggcggcaagggcatcggccgggcggtcgtcgaccgtttcgtggccgagggtgcgcaagtcggcgtactcgtgcgttctgcggccgatgccgatgatctggtggcggcgcatggcgaccgggtggccccggtgatcggcgatgtccggtcctgggacgacaatctccgcgcggtgaccaccgtcgtcgagcgcttcggcaggctggacgtgctggtgcccaatgccggcgtctacgacttctcggtgccgttcgaagaccagaccggccccgagatcgccgcgcgtttcgacgagctgatcgccgtcaacgtcaaaggctatctgctcgccgcgcgggcggcgctggaaccgcttcgggccatgcgcgggtcgatcgtcttcacgctgtcctcctcgtccttctatgccggcggcggcggggtgctctacgtcacctcgaaacatgccctggtcggcacggtgcgccagctcgccttcgagctggcgcccgagatccgggtcaatgccgtcgcccccggcggcacccgtaccggacttggcggtctcgcctcggccggggcggaggccacccgtctggatgcgatcgagggcttcgaccgcatggtggccaaaaccgtgccgctgggcttcctgtccgagcccgaagaccatgccgatgcctatgtcctgctcgccagccgcagcgcctcgcgcttcatgaccgcggtgatcctgccctccgatggcgggctggaggtgcgcggcggcggccggcgcaagcgcggctgacccgcgccatctgcaaccggagataaacaatgaccaatgacgtggcaagccaggttgcatcgctgaaagaccagctgcgcctgccggtgatcgtggcgccgatgttcctggtctcgggccccgatctggtggtggaggcctgccgggccgggctgatgggctcgctgcccgggcccaatggccggacgatcgaagatctgcgggcctggttcaccgacatcgccacccggctggatgccgcgcgtgccgccggcgagcggccggcgccctgggccttcaacatgatcacccatcagagctatggccgtttcgacgacgagatcgcgctggtgcaggagttccgccccggcatcgtgatcaccgcgctcggcggcccgcatcgggtgaccgatgccgtgcacggctatggcgggctggtcttcgccgacgtgaattccgcaggcttcgcccgcaaggcggtcgacaagggcgccgacgggctggtgctggtctgttccggtgccggcggccataccggcgaatatgccatgctcgccttcatcgacgaggtccgcagcttcttcgacgggccgatcgtggtcggcggcgcgatcagccatggccgcagcgttcgcgccgtggaactgctcggcgccgatttcgcctatatgggcacccgcttcatcgccacccccgaaagcctggtctccgacgactaccgcgccatggtggtcgacagccggatggaggatctggtggcgtcgcgcgccatcaccggcgcgctcggcaactggatgcgggtctcgatcgaaaaggccggcatcccgctcgacgccatgaaggccgaggcgaagatcgatttctcgggcgacatgcattcgggcgtgaaggcctggaaatatgtctggagcgccggccagggcgtcggcgccaccgaccgggtcacccccgtgcgcgaactggccgagcggctggtcgccgaatatctggcggccttccgggccgaacgcaccacccataccgccttcgcccgccgcaatggctggcaggccgcagcggaagccgcagaatgaccgagatcacccccgacatccaggcggcggccgcggcgattttcgccgcccgcgagagcctgacccagatcccgccggtgcgcgagacccacggcatcaccgatgtcgagagcgcctatgccgtccaggcgctgaacaccgcccgctggatcgaggccggccgccgcccggtcggcgccaagatcggcctgacgtcgaaggccgtgcaggagcagctgggcgtgggcgagcccgatttcggcacgctctgggccgattacgccttcggcgaaggcgatgtcgtgccgctccgccgtttcatgcagcccaaggtcgaggccgaaatcgccttcgtgatcggccggcggatcgatgatccgcagatctcgctcacccggctgaccggggcgatcgattgcgcctatgccgcggtcgaaatcgtcgacagcgccattgccgcctggaacatccgcctcgccgacaccgtcgccgacaatgcctcgggcgggggcttcgcgctcggcaccgaaccccgccggatcggcgatgtcgatctgcgcctgggcggcatggtgctgaccctgaacggccgcccggcctcgatcggtgtcggcgccgcctgtctcggccatccgctgaacgccacgctctggctggcccggcgcatggcggaactcggccggccgctggaggcgggcgacatcgtgctctcgggcgccctgggccccatggtgccggtggcctcgggcgacgtttgcaccgtcgagatccagggcttcgcgccgctttccttcgtgttcggagactgacacccatgaccaaggtcaaatgcgccatcatcggctcgggcaatatcggcaccgatctgatgatcaagatcatgcgcatgtcgaagacgctggagatggcggccatggtcggcatcgatcccgagagcgacgggctgaagcgggccgcacggctgggcgtcgccaccacccatgacggcgtcgaggggctgcaggccctgccggtctatcctgagatcggcatcgtgttcgacgccacctcggccggcgcccatgcccggcacgaccggttgcttcaggccgacggcaagcaggtgatcgacctcaccccagccgccatcggcccctatgtggtgccgccggtcaatctggatgccatgcgcgacgcccccaatgtcaacatggtcacctgcggcggccaggccaccatcccgatcgtggcggcggtggcgagcgttgcaccggtgacctatgccgagatcgtggcctcgatttcctcgcgctcggccggccccggcacccgcgccaatatcgacgaattcaccgagaccacctcgcgtgccatccgcgaggtcggcggcgccggtgccggcaaggcgatcatcgtgctgaacccggctgagccgccgctgatcatgcgcgacacggtctattgcctggcgcagacccaggaccgcgaggcggtccgcatcgccatcgagaagatggtggccgaggttcaggcctatgtccccggctaccggctgaagcaggcggtgcagttcgaggtgatcggcgacaacgccccgctccgcatccccggcgttgccgaagcggccaccggcctcaaggtcagcgtcttcctggaggtcgagggcgccggccattacctgccggcctatgccggcaatctcgacatcatgacctcggcggcgctgaagaccgccgaacgcctggtcgacctgcggcgcgagaaggcagcctgacccatgaccgataccactacgtccgacaccaacgcgaccaccccggccctgcgcctctacgtccaggacgtcacgctccgcgacggcatgcatgccatccgccatcagtacacgctggatcaggtgacggccatcgccgccgccctcgaccgggccggcgtcgatgcgatcgagatcgcccatggcgacgggctcgccggctcgtccttcaattacggcttcggccgcaccaccgatctggactggatcgaggctgcggcttcggtgatcacccgcgcgaagctcaccaccctgctgctgcccggcatcggcaccattcatgatctggagcgggcctttgccgccggcgtgcgctcggtccgggtcgcgacccattgcaccgaggccgatatcgcgaagcagcacatcgcccatgcccgcaagctgggcatggacgtctcgggcttcctgatgatgagccatatgaacccgcccgagaagctggcggcccaggcgaagctgatggaagactacggcgcccattgcgtctatgtggtcgattcgggcggcgccctcaccatggccggcgtcgccgaccgggtgcgcgccttccgcgacgtgctggcacccgaaacccagatcggcatccacgcccatcacaacctgtcgctcggcgtcgccaattcggtggttgcggtcgaatgcggggcgatccgggtcgacgcctcgctggcggggcagggggcgggggccggcaatgcgccgctggaggtgttcatcgccaccgccgaccgctatggctgggcgcatggctgcgatctttatgcgctgatggatgccgccgacgatctggtccgaccgcttcaggaccggccggtccgggtggaccgcgagacgctgagcctcggctatgccggggtctattccagcttcctgcgccacgccgagacggcctccgccacctatggcgtggatgtccgccgcatcctgaccgagcttggccggcgccgcatggtcggcggccaggaagacatgatcgtcgacgtggcgctggatctggcgcgcgaggcgcctcagggctgaggtggactactggtggcgccgtccggtgtcgtcaccgcgggggccgtcagcagctccatgaccttgtcgatataatcctgctccgccacctggtcgcccagcgtcttgtgcagcacgctgtcgcccatcatggcgcaataggcgatataggaccgcttgcgcgcctcggcctcgtcgaagccgtgatcgcgaaagatctgctcgaaaaagctcatgcggatctggtccacctcccagatcgccttgcgcggcatttccacccgccgcgcccagtcgcggatgctggtttcgatcgcggcgaaggcctgggatttcgggcggcggggcagggcgagcaggtggcggagccgttccataccgcccggcccggccctggtgacgctgcggatgacgttcagcgtcatccggctgcgccaggtgttcagcatggcggccagcaggtcgctgcgcttcttgaagtgccagtagaagctgcccttggtgacgcccagccggtcgcagagtttgtgcagctggatgccgcggacattctcgtcgaccaggatgtcgatcgcggcttccacccagtcggcctcggtcaaaggccggtccttgacacgcttcgtgggggcgcggcggcgcttttcaggtggggcggtctcgctggtctcggccatgtctcgggatatccggtggttccgcaacgggggcagccccccttgcactgcaacaagccgccacaataccccagggtcttgctgagtccatgagacaaaagcgggccatgagacaaaagcgggcgcccgcgcgcaccccacgcccaattgaaaggcagatgaagatgagcccgatcgttatcatcggcggcggccaggccggtggggccgcggcattggccctcaggcgccatggcgcgaccggtcccatcaccctgatcggccgcgaacccctgccgccctatgaacgcccggccctctccaagggcctgctgctgggcgagacggcgttcgagaagctgctcgtgctgcctgaaaccgtggcggccgaacaggcgatcacgctgcgcctcggcaccaccgtcaccgccatcgaccgggccgcgcagacggtcaccaccgatgccggcgacgttctgccatacggaaccctgatcctggccaccggcggccgcgcccgcgcgctgccggggcttgcccccgacggtcgcgacatcttcgcgatccgcaccgccgccgatgccgaggggatccgtgcgcgcatggcccggtcccgctccctgctcgtgatcggcggcggctggctggggctggagctcgcggccagtgcccgcaaatcggggctcgacgtcaccctggtcgaggcgggcccccggctctgcggccgggtgctgccgcccgcggtctcggccatcctggccgatctccacacccgccgcggcgtcgatctgcgcctcggcgatgccccggtggcgctcgcctccaccgggaccggcggcgtcaccgcgcggctcgcctcgggtgcggttctggccgccgacatggccgtggtcgcggtgggcctgacggtcgaggacgatctggcccgcgccgccggcctcgccaccgccgacggcatcctgaccgatccggccggccgcaccgaagatccggcgatcttcgccatcggcgatgtcgcccgcaccccgcaccccgccctcggcagccccacccggctggaaagctggcagatggccaatctccaggcggaggcggcggcgcgcgcgatcctgaacctggccgtgccgcccgccgaaaccccctggttctggtcggatcagtacgacctcaacctccagatcctgggcctgcccgacatggcggcccaacccatccgccgcggcagccccgagaccggccgtggcagcctgctctggctggatccggccgaacggctctgcgccgtcatcgccctcaacgccccccgcgacatcgccatggcccgccgcctgatcggcaccggcctggtcatcgaccgcccccgcgccgccgatgcggcggtgccgctgaaggatgcggtgttccgggcggcctgaggtgccggaagatctggagggcgggcagggcttgccgggcggggcaacacggcggatgatgccgtctcactttccgggacgatccgccgtgcttgcttcctccgcctcgctgcgccctgcctcgcgaccccatggctgacgacctgctgttcagcctctcccccgccgacctcgccggcgccggccttgccatcttcgtggccgggttgctgcgcggcttcaccggtttcggcttcgcgcttgccgccgtgccgctcgccgggctggtgttgccgccggcgatgatcgtgccggtggtgatgctcacccagctggtgatcggcagtgccgatgcggtgcgcgagcggcgggcggtggactggcggctggtcggctggctgaccctgggccttgccatcgccaccccgctcggcacctgggcgctggtggcgctgccgggggacatcacccggatcgtgatcgcctgcatcgttctgctgggggcggcggccgcctggcgcccgccccgggccgaaagcgcgggcgagggcgggctgctgcacgcccgcatcacccggctgggcgtgggcctggtcgccgggctgttcaccgggcttgccgccatgccgggcccgccggtggtcgcctatatgctggcggcagagcgcgacccgcggatcatccgtgcgacgctgatggtgttcttcttcttcaccgcaatcaccggctgtgccagcgcttggttcgccgggctgatcggctggccggagctggtgatgtcggcggcggccctgccgctggtggtcggcggcagcgcgatcggggcggccggtttccgccgggccgatgcccgccactaccgccccgcggcgctggtggtgctggtcggcgccgccgtggtgacccttgcgcgcgagattttctgatcgcgagcgacgaggggaagccgctggcctcgcccttcccggcgggctataagccggaagagtgaacttcccccgccaaccgacgccgacgaggccgtcatgcccctcgatcccgacaccctgttggcgagcagcatgttcatcaacgcctcgggtgccatcgtgttcagcctgttctggctggcggaccgccgctcgccggaactggcgctctgggcagcggggtatgtccttataacgctgggcctgctgggcatgatgctgctgtccacgacggactatccgtccgcctgggcgggcggggcggccttcctgctctgcggcctctcgcccgcctgcttctggctgggcacccgctgtttcgacaggatccggccggtctggtgggggccggcgctggtcgcgggcagcatgcccggtctgcaatacctcgtcggcatcgaactcggccggccaccggcctccgtcgccgccaccaccgcgctgctgctggcggtgctctacgccttcaacacccatgtgcttgcccgcggcatcggccgcgatccgtcgctgcccgggcgctggccggtggcgcgcatggtggtgtccgtctgcctcggcctctattgcctcagtttcattgcctcggcgctcgtcacctggcatggcggagggtccggggtggaggcggaggctgcctcgatcgtgatcgtctcggtggtcgacaatctgctgggggtgatttcctgcatcgccatggccggcatgctctgggaacgtgcccgggccgatctggcgcgcgaggcgcggatcgacccgctgaccgggctgttgaaccgccgcggcctgcatgacggcgcccgccgctggctggcccgcagccggccgctggcggtgatcatcgccgatatcgaccggttcaagcggatcaacgatgcccatggccatgccggcggggatctggtgctgaccaccttcgcccatctgatccgcgatgtctgtccggccgaagacagcctgctggcccggatcggtggcgaggaattcgtgatcctgctgcgccatgctgaccccgatgccgcccggcacttcgccgaccggctccgccacgaggtcgaaaccggcggtttcctggtggcgggcgaacggctcgcgatcaccgtcagcatcggcctcgcctttccctcggcggccgaaaccgacctcacccccgccctggaacgcgccgaccgcgcgctttacgctgcgaagcgtggcgggcgtaatcgggtggaggaactggcggcggtctgaccggcgggtgttacaccgcctgccccgccgcccagcccgacgaccaggcccattggaaattgtagccgcccagccagccggtgacgtcgaccacctcgccgatgaagtgcaggccgggcagtttgcgggccatcatggttttctggtccagttcgcgggtatcgacaccgcccagcgtcacctcggcggtgcgatagccttcggtgccggccgggcggatccgccaggcgccgaccgcatctgcaagcgttctcaggcgcctgtcgcccagatccgccagccgggcggtctccaccccgtgatcctcggcgatgcgctgcgccagccggcgcggcagcaggcgagagagcacggtcaccggcgcctgacggccgctgtcgctgcgtgcctggcgcagtagctcgaagacgtcgacgcccggtgccatgtcgaccacgatgtcgcgcccgtcgcgccagaaggacgagatctgcagaatgaccgggccgctgaggccgcgatgggtgaagagcagcgcctcgtcgaagccggtgccgtcgcacgacacccgcgcatccaccgccaccccggcaagcggcttgacccgggccagatcctcgggcccgaatgtcagcggcaccagtgcgggacgggtttcggtcaccttcagcccgaactgccgggcgatgtcgtagccgaagccggtggcgccgatcttggggatcgacaacccgcccgaagcgatcacgagcgaggcgcagtggatcatctcattgccggtccgcagccggaaaccgccatcggctgccgcctccaccgtctccaccccggtcgagagcgcgagttccaccccgccggccgccatctcgtcggtcagcatggtgatgatctgctgtgcgctctggtcgcagaacagctggccgaggattttctcgtggaaggcgatgccgtggcggcggaccagggcgatgaaatcctgggatgtatagcgcgacagcgccgagatgcagaagcgcggattttgcgacaggaagttgcgcggcgccgtgttcagattggtaaagttgcagcgcccaccgcccgagatacggatcttctcgcccggcgtctgcgcgtggtcgaccaccaggacgcgccggccgcgccggccggcttcggccgcacacatcatgccggcggcaccggcgccgatgatcaccacatcccgatatcgcgtcttcatgcccgacgtcacctcaaagcttcagccttgctctatcatgagccctgcgccggctgaagagccgccctgcggaaaaccctccacattatgagaatttcttaaccgctcatcggttacaaaccggagacacacgccggcctgcctgtggcggcggtgcggaggcggtgcagaggagcggggcatcggcatggcgcgtcggtcttggttcggagatggagctggggggcaccgcctgcggatgctcaggcccgcctatgtccgcatcgtgccggtgcttgtgctgttggccgggcttctggccgcgggcaacgcctggtaccttcagcgcgacgagaaccggtaccagaccacgcgggagctgaaccgggccgctgcagaggctgcccagaccatcggcgaccggctgcagatcatcgagcacaccctgcatggcgcccgcggcgccatggtggcggtgggctcgcgcagcttcgacgaggaacgcttccggcggttcgccgaggcaatcgattttcgccgcgacctgccgggcgccctggcgctcggcttcgtccggcgggtggagaccgccgacctcgctgcctatcaggcccgggaacggcgcgaggggcgcgaggattttcgcgttcagccgattgcgcccggccgtgcgggcgagcatctgatcgtcgaatatgcccatccggccggcgccgaaggtctggccaccgggctggatctggtgaccaaccccgccatccgcgaggcggcggcactggccctcaccatcgacaccgccgtcctcagtgcgccgttgatcctgcgcccctcgggcccggccagcgagatgaccggcatggtcatggccctgccggtgcgcagcgccatgcacggacccgccgatgccctggtgatcatgtcgctggcggtggatcgcgtgctcggcctgggattgtcgcgcgacgacacgctgatggtcaccatctcggacgtcaccgaccatcccggcggcgcgatcctgcagctgaccggctcggccgacctcaaggggcagcgcgtctaccggcccgtgaccttctacggccggtactggcgcgtcgacgtcacccccggcccggccttcatcgcgcgcctgaacctgttgtcgccctggtgggtggcggcaagccatctggggctggccgtcatcgcggcgctgctcgcctatctgatcctgaaccgggtggaccgccggctgcgcgacgatgcgcgccggctggccgccgccgacgagctggagcggctggtcgccatccgcaccgcggaactccgcgagcgcgaagcccgcttccgcgccatcaccgaactgtccgccgactggtactggcagaccgatgccgatggccggttcatcgaaatctcgggcgggatcgagcgtttgggcttcgaggccgaccatgtcgtcggccggagccggcgggagctggcggccgatccggatgatccgggacttgcgatctatgatgccgtggccgcccgccgccagcccttccgccgcgtcgcctatcgtgttgccggcggcgagggcgagatgcgcaccatcgagatcagcggcgacccgatcttcggggcggatggccgcttccagggctatcgcggctcgggacgcgacgtcaccgacgatgtggcggcgcgccgcgagatcgagcaggcctatgctaccgtcgccggcgttctggacgcctcgctgaacgccgtcttcgtctatgtggccgagcgcgacgcggcggggcggctgaccgatctgcgcctcagcatgatcaacgcggccggtgaggcgctgtcgggcgtgcgcgccgatgacgtgatcggcaactccctgcggggcagcctgctgcccggcgaggaagagatcttccgccgtgcccgcagcgtggtcgaaaccggccgccccgagcgcttctatcagctggtcaaccgtgcgggccgcgacatctgggtcatgatccagaccgtccggctgggcgatggctgcgtgatcaccgccgccgacgtcaccgaggcgcggatccgcgaggcgcggttgcgcgaaagcgaggcgcggttgcaggcgctgatcggcacggtgggcgtcggcatcgtcgtgctggacggcgacggccaggtaatgatgatgaacgccgccggcgagcgcctgttcgatcgccgtgcggccgaggtggtgggcgacaatttctgccatctggtgccgcggcccgaggggctggaggctgcaggcgatgacgaatgcggcggctcgatcgccgatggctgcggcgcgatccaccaggcgatcgccctcagggccgacggcacctccgtgccggtcgaggtctcgatcggtgccttcgataccggcgatggcccgatgtatgtggccgcgatcgccgacatgaccgaacgcgaccgctccatggccgagctgcgccgggcgcgcgaggaggcggatgccgccaacgcggccaaatcggccttcctcgccaatatgagccacgagatccgcacgccgatgaacggtgtcaccggcatgctgcagatcctgctcgccaccccgctcgatgccgatcagcggcgctatgccgaggtcgcgcgcgacagcgccgacagcctgctggggctgatcgacgacattctcgacgtctccaagctcgaagcggggcggatggagctggagcgcctgcctttcgatctggaggagctggtcgacggcgtgatcgcgatcctcgccccccgcgcgcgggaccggcggatcgatctggccggggtggtcgactcctcggcggtcggtagctggatcggcgatcccacccgtatccggcagatcctggtcaatctggccggcaatgcggtcaagttcaccaccgccggccatgtgtcgatcgaggtttcggcgatcgccgccgatgacgaccgcgggcggctgcgcttccgggtggaagataccggcgtcggaatcgcggccgatcatctggaccagctgttccggcccttctctcaggccgatgcctccgtcacccgccgcttcggcggcacggggctggggcttgcgatctgccgcgacctgaccgcgctgatgggcggcacgatcgatgtcgtcagccgcgagggcgaaggctcggtgttcacggtcgagatcgggctggagcgtgtggccgatgcggcgcgcacgaccccctccatgccggtgctggccggtcggcgcgcgctggtggtcgacgcggtagaggtcacccgccgcatggtcgcccgccagatcgaggcgctgggcatggactgcgtggaggtcgcctctgccggtgaggcgctgatcatcctggagatgagcgtcgccggcgaacgtccgatcgatctggtgatcagcggcctgaacctgaccggtctcagtgcggcacgtctggcgcgctgggtacggctggatccggatctggcgggggtgaaggtgatcgcggccacctgcggcgtaccggtgccggacgaagaactctatgacggcgtgatctccaagccggtccgccggcgcgaactggcggatctgatgcaccgcctgctcgaccccgaggccgcggccgcccgcggcgtcagcccggccccggccgaggggccgggccatggccggcgcctgctgctggttgaagacaatgccaccaaccgcaccgtggcgacggtgatgctggaacgccagggctatacggtcgagaccgccgagaccggcgaaggggtggagctgcggcttgccgagggcagtttcgatgccgtgctgatggacatccagatgcccgtggtcgacggtatcgaggccacccgccgcatccgcgccgccgaggcggcggcctgcctgccgccggtgccgatcgtggcgctcaccgccaacgccatggcgggcatgcgcgaagagtatctggcggctggcatgaatgactatctggccaagcccttccaggtcgacgacctgctggcggtggtcgcaaagtggtgcggcggccgggcgacgccggccgcatccgcccggcctgcgcggccgccggccgtgccggttctggacgaaaccgcgctcgaccaggtggcagccgtgctgccggtggagaagttcgaggatctggtccagagcttcgtcaccgccggtgtggcccagctggatgaagtccgcgccgcccgcgccgcccgcgatatcgaccgcctgcgccgcagcggccacgacatcatctccacggccggcaattgcgggttgatgcagctgtcggacgccggccgccgcctgcaggtcgcggcccgcgccggcgacctggaccaggcggtcgaagtggccggcgaaatccttgatgtcggcccggccgccatcgaggccgtccgcacccgcttcggctcgccgcgatcggcggcctgaccggctcagtccgccagcccgatctcgcgcagccgctccgccagatagtccgcggctgttttgtctgccgcaagccgcacctcgggtcgcggatggatgaagatcggcatggactggcgggcggtgtggtcgccctgtgccgggttgaccacccgatggggggtggcgggcagatagccggcggtggcgagtgccagcatgtcgccgccattgaccgcgatcatgccggcatcgcagggcacggcatgccagcggccggcggtatcgcgcgcttccagccccggttccgagcccgcgaccagcagggtgatcaggttgatgtcctcatgcgcggcggcccggacggcgccgggctcggcatcctcgccgaccggcgggtagttcagcacccggaacagcgagcggtcggagccggcgaccatggcgggcagcggctccgacagccggtcgcggatcccggccggcaattcctcctggatccagccgagcagggtggtgcccagatccgacagctgccgatagatttcgcgggtatcatctgcaatctctggcggcagggccgtgtcgggatagacgtggaagaactccttcagatccttcaccgccacccccttcgcattttccgaccggaaggggaaatagccgctctggctgccgggtgcacggatccagccccgctttgccggatcggcgaagaaccgtgcccacccggcatgcaggcgggcgatcagcccggcatcgatcggatgcgcacggagcaccgcaaatccggtatcgcgcagcgaggccaggaaccgggccggcgcccgggcgtcggtcatgtcgatgctgtcgatggcgaacatatgagagggcaccctagtgcattgaccgagcggaagggacatattggaggagcattctccggcgatatatgggtagaatctaccctggatatgtatatatctctatcttcggtgcggtgtcgcctatcttacctatccgtggattgctacggcctcctggaacatgtttggcaagtcttgatcatgctgggggcatggaggtagtgggggatgatagtgatgtaggcaggaataatggcggtgatttggcgctggccgcttcggttctatgaaaaaggacggagttgtggttgaggttcagaagatcatcatagatgaattttggcataagatgatatataaggtatgtatattgttaatatcgtgcctttctgtcgtccataaaccagagatatcacatgcgtctgaaaatgtaggcgcgttgattggttttcacgaggatccgttgcctatatatgaccgctttgtttctagaggaccgataggatatctacatatcgaagatatttcaaaagtaattattttagaaatcgacaatgtatatgtaattttcagttacgatgatgaaaaatatataacgagaagatttcttttggagttttcaagagagactaatgaagattgcattaggttggaagataatatttctggctcaaggtctgtaggatacgcgtgcagatgaagaatttttggaaggtgtcaatttttaaattgaaaaaattcccattatatgtgattattccattctcattagtagtatttttccatcaaattgatttatttggaataaaaggtcagacagaaaagcagtcggctcgaatgatcaatatcgcgctttctcacatgtatccttcgcataatagctatgtcttgccagtcatcataacggaaagaacgttagaaagacttggatcatcctatccattgcccgaaaatatattatcggatatgatatatatgctatctcaatttggagctaaagctatattcatcgacatgactttctccggaagaagaaaaacagaattatcacatcttcttcaggcaattaaatatgcagctagtaatagaactcatattttttttccaattaatggatacaaaagtgaaaatttcgacgatattatgaaattaataaatgaaagcccgtcaattcatgccgttgacatttcgcttggaaataatagatccggattaaattacccaaagaagaggaatatagcggttctgacgcctgcttttgccatatgtgcggctttctacggcgaaaactggtgccgatctgatgttgccaagctggaaatcgcgaacatatggtggcgaggatcggaggaagagagcctatatgacgccgctaaagatgttctgcaacatatcattcggaacatctctggagatttaaaatcgtatgatgataataagccaattgtatatataaaaatggaaacctttgagtcaatatacctcggagaattctcgggcacggatagggaaaagctaacgagtcagatcgtagtcattggacaaaatttgcatggattaaatgattctgttgaaacgtcaattgatgactcgatgcccagccttctataccatgccatggcgattgataatctagctgcactagaaacagaattctctataaataaaatctctcggcatattattgaagtaattatagcaataattcactatgtctcaatatgtatatatagaaaatatacccgaaaatattatgaatgttatatttataataatgaaaaattcataaaaaggctcattgtactgccaatattaaacatcgtaccgactatcgttgtttttgggatgattttcatcatgtcgattctattattcgagttcttgcagatgaggtctgtcttggatctcttgggcattatcggtgcggtggagctcggtagaatgttaacgccggcatcagaagacaaagtgtctaaagtataatgaaataaaataaattcagagtccgttcgagaacttatctatgatttccacctccttgcgattctccgcatcatgatccggatcatggcgaggcggagaaatgccagagccatccgtgacaggttctcgaagtccttggccagcctgggacagcggccgagcattccgaaggtccgttccacgatccagcgtttgggcaggatctggaagctcttggtggtatcggaacgcttgacgatttccagttaccagacgccgagttcacgcacggcggcagccgtggcggtcccctgatagccaccatcggcgaagatgcgctcgatgaacggaaacaggcggcggacctctttcagcaccggcaacgcgccgtcccgatcctggatgtcggcaggctggatctgcgcttccagcatcatgccgagcgtgtcgacgacgatgtgccgcttcttgcctttgacctttttacccgcgtcgtagcccgacggatcgatccgcgcccccctttttccgcgcttttgacgctctggctgtcgatgattgccgcagtcgggccggcctctttcccggccagttcgcggacatccacgaacagggcatggtggatccgcgccagcgtgccatcccattcccacagacccagatattcatgcaccgtgctccgcggcggcagatccttgggcagggcccgccattggcagccggtcatcagcacatagaacacaccgttgagaacttcgcggacatcgaccgtgcgctgtcgaccgccgcgcttcgcgggcgggatcagcggttcgaccagcgcccattcttcatccgtcaggtcgctcggatatctcaggcccggccgttcataaatccggcgggtttccgtcgtccacattctgtccgctccctttttctctggcgcggcatagaatcacaacggattcaccggattcaataacattccggacgggctcttaacgaattagaatatttgtttcgtcaattaaggatattataagaagatggcagtctatatctgatttttggaaatattcgcaaaaagcttgaaggccatcttggcctttttcgaatccatagtattctaagatataatcgaaataattgttcacgtacttttgatatattagattaattttgtatgcttcttcgctgaaaattaaggatcctaagttatcttcaatttctctcctcagttcttttaattctgtaatcggattcattccaaaacacatatctttttcagattttatttttgaacacttatctacgtgcatattcggaataggaggaatcaaaccaaaactatccggatagcgcaaagtgtatgttgccaaataccaagccggcatgcgcatatttaacgcatacatggctttcgctacaaataaaaaacttacatcataataagagccgtgttcataataattggcgagtatttttctatattgtctagttcgcaaccaaaagttgatattgtccaatcgagcataatcataattttttgtaaaataatgctgaggtgcataataatactgaagggggtttcgagagagttctcctaatggagcagggcgaatttcctcagcagatgcgacggtagtataaaaaaagatactcagaacaaaaattgaaaagaatctacccctcattttttaatctccttatttcattgcggatacgcatgatacgttcatcaaaagatccatagtgacccacaggagattttggtacattgtaatatatatagaaccgattgagggctgaaattgctgcatagacatcatagccagctttagaaattagccgcaacccgacggcgtcagccaaatattcttgatccattgaaaaatataacccgctatgcttcgatatatccgaaattacttcattcttagcaatttcgagaaataccaaacagggtggacatgttagatacaccgatagcgataatggtatcagttgcgcgtctttgttaagtctctcgtatgaaacgttttctgcaaataaatcgtcattataagcgatatgaaccatttcatgcgcaatcatccacgcaagttcctgctcatctagtgttcttgaaaactgtggatccactaataatgttccgttctccatcaccgaaaatgtaaatggaatatcctctaattttatattcgtccctaggcgtctattgtattcttccagcgcaagtatatattctggatcagattttattataacgcgggcatattttgtcgaaaaattattcaaaattgcaattttcgtccaagtgcgacgaattcgaatgacttcttcatccttagattttccataccctatcccatcatacgtatagaaatatgttgaaatattattgaaatcatctccatctgatcgaattgatacgtagctgctacaagacatcagacacacggatagtgttgatgtaaaaactattctaagtatgcgataaatattctgcattatctttccacattctgccgaaatgcgcaaagtcgccgtgagaaagttaattagccgggtacattgtaggcgcaattatgtgcgtgacttcccaaattcgcaagatcggttcggcgaaggcgcacggtcccaacatagcagcctcagcgcgccgccaccaccgcagccgcggcgatcatcaggctgccggcgccccggttcagcgcgcggatgcgggccgggcggtccagcaggctgcgggctttcatgccgatcagcacatggccgcccaccaccaccacctcgaccgcggcgatgatcgccagcagcagggcggtatcggccacccccagcggccgcacgccaagcgcacccggaagaagtgccagataaaaaatcgacatctttgggttgctgacattgagcaggaaaccggtgatgtagagccggaacaccccgcccgaggccgcccgcggcttgatcacgggtgccgcccgccacatggagatgcccatccagaccagccaggcggcccccagatactgcacaaaggccagctgttcgttcatcgtctgggcgagcgcgttgaagccgatcgcggccaggatcacgaagccgaaaatgctggtcaccacgcccgcgccataggcgaggccatgggccgggccgtcggccacggtcttcgacagaatggtgacgttgtcggggccggggctggcggcgaacacgaaaaaggcgatggtgaaggtcaggatggtctgcagatccatggcgcccctccgtcagatggccgtggcggtggcttcggatgtcgcatcgaagcggaaatagccgccgggggcgtaatccgtcccgacggatttatagcggcttgcgggggcatcgaagccgaaatcgagatagtgcagcagggcgttgcgcacctggggcgtgtcgatcgtcaccggcggcagcgtcagctcccgccccggccggtcatgggccaggtggcggaagatccggtcgcggatgccgatgccttcgggcatgcggatcttgggtcggttgatcatgacatcggcaatctcgccgcgaaaggcttcgcgcaggatccatttctccacaccgccgcgcagcttcagatcgaatggcagggccatcgcgaaatcgaccagcgcccggcccagaaacggcacccggcattccacggaatgggtcatgctggcccggtcggtgcgttgcagatcggtgcggtgcagattgccgacccgataggtggtcagggcataggggtcggcggcggtgcggaacatgtcgtagccggcgaagagttcgtcggcgccgtcgccggcgatcgcgaccttgaagccgttggccctgacggcggcatgcacggcggacatcgagatcatgtccgagatgtcgaccggctcgaagaactcgccgtcgaagatggcgccccggatccgccgcgggatcatctcgggtgcgaaaccggtgacgatatggcggatgccccgttcggcgcagaaggcgcgggcgaaggccagatcctcgctgtcttccgtgcccaccgaaaaggcggtgacgtcggggtggtggcgggtcgccaggtgcagcaggatggtactgtccagcccgcccgagaagatcaccgccagaggcaggtcggtctgcacctgccggcggacggcggcatccagcagggcccggcagcggccgaccgggtcgggcccgatgacggccgggtcgtgcgccgcctgaaagccggcatagcggctgatcacaccatcggcccagacatggccgggggcaagctcagtcaccccggcgatcaggccgatgaaggccttgcgttccgatgcgaaggccacccagccgccggccgtggccatatagagcggcttgacgcccagatggtcgcgggcggcaaaactgctgccggtggcgggatcatggatcacgaaggcgaagatgccgtccagccggtccacacaggccggcccccaggcgccgaaggccgccagcacggtctcggtgtccgatgcggtgcggaagtgatggccgccggcatcgagttccgcgcgcagctcttcatggttgtaaatttcgccattcatcacgatcaagcggccgcttgccggatcgaccaccggctgacggccatgggcccggtcgacgatcgccagccggttggtacccatgccgccgcccgcacccggcatcccccggccctgcgcgcgccggccctgcgcgcgccggactggcagcagcagatgttcggcgaagttccagctgtcgccccgatggcgcagcgcgcccagcatgcgcatcagcgccgctgccggatcgaccggcggcggcaggtcgggggtggccgccagcggcaggatggctgcaataccgcacatgggcgcagtctcctgcgccggtgggcgtgctgcgggtgccgatggcgaccagcgccgtgcgcgccagccgcgccgtccagccatgggtggaaggtgcaacccggatcgcgcccagcatgtcgggcagggcggcggcaatccgggcgcggcggctggccggggtgtcgcccgcacccaccagatcgtacatccggtccagatggtcgagcagggcatcgcgcgccgctgcggcgtcggcaccgtgcagggtgaaggggtcgtcgatatccatcacccgcacgtcgcggaagccggctgcggtcagcaggctgaacatttcgcttcgggtaaaatggcggtggggatggccggttcgcgaccagggatgaaccacccggtcgaaccagcgggcggtgctgccgccggtttcgaaatcatgcagcaccagccggccgcccgggcggagcgtccggaaggcctcggccacggccgcggggcggtcgtcgtcattcagatgatggctgccatatgcgatcagcaccccgtcgagcgcgccgccccggatcaggctatgggtggcggcctggcgcagcgccggcaggtcccgggccaggcaggcttccaccatcagccgcgacagatcggccgagacgatcatcggcccgggtgtatccagcccgttcacgaaccgcgcgagcgtgccgtcaccacccagcacgtcgagcagcagggtttcgggcccggggatgcgatcgaaaccgggcgaaaacaggcggagcagggccgccatgcccggcgcgcggttgtcggtggccctttgcgccaggttataggcggtaccgcggccgccggtgtcagcgtcctcgaactcccacgaggcggcgttcatggcggcaaccgcatcgcgcagggccgccggcgccgtgcggccggggtcgagcagccggtcgaagaccgggaagcgggaccgcagcatctgcagcgcggccggggcgggaagatcctcaagatagagcggttcggttatgacggactgatcgaaggccagcatcgcgacaccattgcggtgacggacggcgtggggggccgcggtccggagatggatcaatctccggatgctgtattgtcttcagcttttgatcaatatggattcaaagatagaaacgttatggggaatattccccgccatcgaaccggtcccagaccggcaccccggcgaagcgggcgaccaggaagtcgatcagcagccgcgatttggccgccagatagcggttgggggcatagagggcgaagatgtcgagcgccgtgggcgggtggtcgggcagcaccacggccagccggccggcggcgatgtcggggccggtgatgaagctcggcagcgcggtgattccattgcccgccacggctgcggcccgcagaacctcgccattgttgcagcacatggcagcgttgaggtcggcgcggatcgtgccgccgccggggctggtcaatgtccacttctgaagatttgtgctgtggccatagaccaggcagcgatgccggaccagatcgtccggggtctcgggcgcgccatgggccgccagatagtcgggggcggcgaccagcagccggcggcagggggccagcctgcgggcgatcaggctcgaatcctccagctggccgatgcggatggtgacgtcgaccccttcctccagcgggttcacgaaccggtcggacagcaccatctcgaccttgagatcgggccagagccgggcgaagtcggcgatcgcatcgcccagatgcagggtgccgaaggacatgggcgcgttcagcttcagcgtgccgcgcggctggtcgtgcagctgcgccacctgcagctcggtctcgtcgatcgcggccaggatgtccaggcagcgttcgtaataggcccgtcccgcatgggtggggctcaccctgcgggtggtgcggtccagaagtcgggcacccagcaggtgttcaagctccgccaccgccttgctgatcgcggatcgggtcaggccgagcgtgcgcccggcctcggcgaaactgccggtcgtcaccaccttggtgaaggcctgcatcgcatccagcttgtccatgaaggccctcgtccgcctgatccctccccatggcatagcatttcgggggccgccccggcgagcggatcagcccatgccgagcagatgatagatgcgtttggtataagcgccgaattccggcgtcgccttcatgtccagggtccgcggatggggcaggtcgatcgggaaatgatcggccatccgcgcggggcccgccgtcagcaccgcgcattgcgagcccaggaacaccgcttcctggatcgaatgggtcacgaagatgatggtcttgcggctctcgccccagatccgcagcatctccagattcatcttctcgcgggtcagtgcgtccagcgcaccgaagggttcgtccatcaggatcagcttggggtcgtggaccagcgcccgggcgatggccgcgcgctgctgcatgccgcccgacagctcgtaagggtatttggtctcgaagcccgacaggccgaccatggccagcagctcgcgcgcccgcgcctcggcctcgcgccgggccaggcccaggatctgcgccggcaggatcacgttctgcaggatggtgcgccatttcagcagcagggcctgctggaacaccatgccgacatcgcggccgggggtgaaggcagaggtggcattgccgatccgcacctcaccctcttcggcgtcgtgcagccctgccaggatcttgagcagggtgctcttgccgcagcccgaggggccgaccagcgagaccatctcgccctcgttcacatccatggtcacatccgacaccgcaacgaattcgcgggtgccggtgcgatagaccttgcgcacgcccttcagccggatcagcggctcgggcgtggtgtcgatgcgggcggcattcatggtcatgacagccagcgctccaggttttcggccacgaaggcatcgtcggacagatcggcatgcatccggcacacccggtcgagttccgccgcctggcccgggctcagcccctctgcggggtccaggcaccagatgccttccagcaggccctggcggcgcaggatctcgtgacagccggcgatgcagccgtggaaatcattggcgacgtcgaagaaggcggcgttgcagtcggtgacgcgcgaatcgagtgccagcagatcggccggcacgtcgccgccaccggctgccgccttcagccgctccagcatcaggaccgcctgccgggtccagaccgaccagtggccgagcagcccgccgcggaagcgcagcgtcaccggcatgccgtcccgcatcaccgtgaacggggtcagcaggtccagcacgatatggtcgtcattgccggtatagagcgtcacccgatcttccgcccgcgccgcgaccacgccgcggatcacgtcgagcgtgcgatagcggttgaagggggcgaccttgatcgcgatgacattgtcgatcgccgcgaaccgcgaccagaaatcggcatccagcgacatgccgccgaccgcaggttgcaggtagaagccgatcagcgggatttcttcggccacccgggcgcaatgggcgatcagtgcgtcggtatcctgacccgccatcgccgccaggctcagcagcccggcgtgatagccgaggcccactgccgtctgcgcctcggccaccgcctgatcggtgcggccggccagccccgccaccatcaccagcggccggtcggtccaggcctttgcatcggccatggccgcgctcagcaccggttcgtacagccccacctcgcggatcgcgaactgggtggtgtgcacgccgaccgccagaccgccggcaccggcatcgacgtagtagcgggtcagcgcccgctggcggcgccggtcgaagcgccggtcccggtccagcgccagcggatgggcggggatggcggtgccggtccggatacgctccaggatctccggcggcagggtcgagcggtgcagggtcatcgggtgttttccttccgacgaagtttcccatgaccaccatcgtccacgatggtggtcataagccgccattgaggcggcggccaagggcgcggcagcgcccgcccggcgaggggctgacaggactcgctacccgaattcggggccggcggcggcataaagatggagagggttgccaacaggggccggatgatgaagcgccatacgcaggaacgggcggcgtggcacgaaaccgcgggtacgcagcaggtcggcgaggccggcatgatggtcggcaagatcgatgatcaacgggcctgaggcggccgcgatggccgcctcgatcagccgcgccgccgtgctctcgtcctccgcgaccaccggcccgatctgggtggcgacccggcccgggcggcccagggcgaagccgctgccggtgtccgcgatcagcgccggggcgccgctggcggcaagcccggccagcagctccgggcggggggcgccaagggctgcggcatcggccctggtgatccggggcaggtcgcccggcacgatgcgacgcaccccttcggggatactgccgccgccggtgccttcccagcgggtcaggccgaaccagggcaggaagccgagcgggcgatagacctgttcccctgccggtgtcgcatccagcaccggcagcaggccctgcgtgcggcaatggtcgaggcagaccttcaggatctgcgtgccgagcccgccgccccgccggtcgccccggaccagcaccatgccgatccaggcgacccgtggcccatgggcgatcaccgcaccggttgcgaccggtcttccgccctcggtgatgccgaagacggtgcccgaccggaagaaggtcatccaatcggccgcggtctggttccagccggccgcggccgagagcgcccggcagtcatcaagggcgtcgggcgtaagcggcgccggctcagtaggtgccatcccgcacctcgaaccgggtcggcttgccgaaggccggccgttccgccgccacccagtccgccacccagtcgatcatccggttgagcggcaccagcgggtagccgaacagcccggccgcctgtgccgtgttggtcagccaggcggtcggcgcctcggtaccggtgatcaccgcttcgcggcccagcctttcggcgaaggtgcgggccagccagcgcaccgcgatcgtctcggggcccgagacgttgatcgggctggtcggatcggtgcaatgggccaggcagcgcagcgcctgggcattggcatcgccctgccagatgacgttgacatgacccatggtcacgtcgaccggctcgccgtcgcggaccttgcgggccacgtcgaacagcacgccatagcgcagatccacggcatagttcagccggaacagccggccgggggtgccgtagcgttccgagaaatggccgaagatccgctcgcgcccgatgcacgagaaggcgtattcgccgggcgggttcaggatgctgtcttccgtcgaaccctggctcgacacgtcgacgaagggatagacgcagccggtggagaaggcgacgatccggctgtcgcggaaatgttcggccaccatcgacgggacatggacgttcatcgcccaggtgaggttggccgagccggtggcgccgaatttgcgcccggccatgaacaccacattgcggacccgaggcagggcggcgatggcgtcgggatccatcagatcgcaggcgatggtctcgaccccatgggcctccaggctgtcgcgcaggcccggctcgctgaaccgggcgacgccgatcacgcgcttgtcgggtgctgcattgcgggcgaggcgggcaagcgtcgggcccatcttgccgccgacgcccagtaccatgatgtcgccgtcgatcgcggcgaggtcggccgccagcgcccgcgacgggcgggtcaggaaatcgtccagggcttcggtgccgtcgaaacggtcggggaaggcggcgtcgtcgagccagacggtcatttcatcctcgcatccttggggaggaacaggtgttcggcggcgagcaccgcgagatagagggcgaggccgagcagggtcagcatcaccaccgccatgaacatggcgggcgtgtcgagcgaggcctgaacctggatcatcaggtagccgaggccgcgttccgaggcgatgaattcgcccaccaccgcgccggccacggccaggatcgcggccaccttcatgcccgagaacagatagggcagggcgccgggcagctggatgtagcggaaggcctgccagcgcgagcccttgagcgagcgcaccaggtcgagcaggtcgggctccacttccttcagaccgcgcgcggtggtcagcaggatcgggaagaagcagagcaggaaggtgatgaggatgttggtgccgatgccatagctgaaccagacgatcaccagcggccccagcgccaccttggggatcatgttcagcgtgaccagcagcggaaacaccagcagtgtcaacggcttcgaccacgagaaggcaagcgcgagcgccacccccaccaccaccgacagcgcatagccgccgaagatctcggccgcggtgacggcggtattgccgagccagtcatagccttcgccgccgagtgtggcgaggacggccgccggggacggcaggatgaaggcgggcaggtctgccaggcgaaccgtcagctcccagagcgcgatcgcgcccagatggacggcgacgaccgccgcctggcgccggcgtgccgccgcgcgttcggccttcacctcggccgccgcgcccgcgctgcgggcgtcctcctccacgaggctggtcatgacatggggtccctcttcgaacggccctggtgaacgggtgtcggcccgcggacggctggcgtccggttccctcggcctcgccctccggccacaaaacaaggctagggcggctggatttttgagtcaactaaacagttgacttaatttcacgcggtcgcgcctgccaccggtcgcagggccgagagcacaaaatcgatgacatggcgccggcgacgagagacctcgcgtgccgaatccaggttggtatcgaaaatggcggaaagggtgtgattgttggcaaagaagaaataggcaagacctgcgatcgagatatagacgttgatcgcatccatgtcgtcgcggaacacgccgtcacgggcaccgcgggtcagggtttcttcaatcatcacgatcaagggtgaatgcattgcctgtatttgcggagagtccttgatatgccgggcctcgtgacggttctcgtcgttgagcagggcgaccagctcgggatgttcggccagatggtcgaaggagaagccgaccagccgctccatcgccgccaccgccggcagatcggccagatgcagggcctgttcccgtgcgcggatctcaccataaacctgttccagcgcggcgcggaacaggtcttccttattgccgaaatggtgataaaccaactgcttgttgacgccggcccgctgcgcgatctcgtcgacccgcgatccggccaggcccttgtcggcgaattcggcgatcgcggcgctgagcagagcgcgccgtgtcgcctcgggatcgcgcttctggcgagccgggcgcttgtcgttcatccgcggggagtcgttcatcggggccacttccaaattatcaaccaaccagttgatttaacattgccgggtcccggggtgaagcgctaagcttttccgcgacagggccgtaacgccttccttaccacaatggaagcggcggtgccgatcagggaaaagtctggcctcaccgggaaaagtcagggagttgaagggcatgaagatcacggggacccgtgcgactgtggtggcggcgatggtcgccgcggtctggatgcagccagctgccgcagccgaatcggtcgatctggtgctgaactgggtgccgaccgccgaccattcgccctattactacgccaaggcgcagggctggtatgaagaggcgggcatcgacctcgacatccagaccggcaagggctcgggagtttcggcccagcgtgtcggcgccggggcgtcaaagatcggcatcgccgacatggcgaccgccctgctggcgaagagcaagggcgccgatctgaccgcggtgatggtggtctatgccaactcaccgcaaggtttctactggttgaagagccacggcatcaccgggcccgccgactttcccggccacaagatcggcaacccgccgagcgatgcctcgcgggtgatgtggccggccttcgcgcagaaggtgggcatcgatcccgcgtcggtcagcttcgtgaatgtcagcccgcaggccaagatggcctcgctcaagagcggcgcgatcgatgtcaccaccgatttctataacgaacacgatctgaaggtgcgcgagttcggcgacgatctgggcttcgtggcctggcgcgatatcggcatcaacccttatggcaatgcgatcatcgtcaatggcgatttcctgaaggacaagcccgaggtggtggaagccttcacccgggtcagccagcgcgccttcgccgcctgcgtccgggacgtcaccccctgccttcaggcactgctcgcggccgcctcggggctgaccgaagccaaccagcgcgaccagtggaaccgggtgaaagagctgatgcgcgacccgaccaccaccggcacggccctcggcgccttcgaccccgagcgggtcgcggccgactatcagctggtcgaaacctatttcggcatcgaaaaacccttcgacgtgaccggcgcctataccaacgacttcctggaccacggcatccgtatgaccgcggagtgagccggccggacgcaggcgtacaaccggctgccggcggttcaggccggtggtcgcgatgctggtggtcgcgatgatgctgcggccctgcgccgcagatcggcgaccgtcagccaggtggccgagatcaggaaatagaccgcccccagcgtcgcatagccggtaacgctggtgatggagggaatggcgggcaggccggcgcgcgagatgaacagcacgccggccaccgccgactgcgccccactcagcaccatcgcccattgcgcgccgaaccccttccagcggcggatggcggtgccgagttgcagcaggcccgacaggatcgcccaggcgccgaacacggcgagcacctggttcatgccgttctgtagtgcgatgacgaccgcgagggtggtgacggcgctgacgccggcattgatcgtctgtgtcgggttccggcgcagcccgccattgcgcgcgccgtcgacgaggttggcggctgcatcccaggcgggatagaggatgagcagggccatggcgaggccgggcgactgctgcccggcggtgagggcgagcagcacccagatggcggagaaccccgcccgtgcgaaatagtagagcctgagccatctttcctgagcggcgggtggcaggccggcggatccggtcgtcatgtcgtgatctttctgtcgggtgacggaagggaaggtgcgtgcctgcaatgcgtggtcttttataatctacctactaatagatagtttgcggggcgacagatcggccggtcggccggtcggcagaccctgcggccggtagataccgggtcagacggccgcgagcctgtcgatcagggggcgggtgatcatgccgaagatcgccgggtctccacaggcgcgtgcggagagcatggcgccgtgtactgtcgccatgaagctttccgccgccacccggggcggggccgcgagaaccatcgtgcccccggcggcgccctggtccatgaccgcggccagccatgccgaaagccggcggaaataggccgtgacttcctgcgcgacttctggtggcaggaccggaatttcgcaggcgagcagcgcgcaaacgcagaagctcaggctcccgtcgccgatgcagccttcccagaagccgatataggcgcgcagctgatcgagcggttccggatgatgccgggccagcgccgccagccccgcttcggcctcgtcgcgatactgcacgacgagcgccctgaccagatcgacttttccgggaaaatgatggtgaatactcgcctttcggatgccgaccactgcagcgatatcggcatagctgaagccgttatatccccccgcgaccaccagtgtgcgggcgcagcggagaatgtcgtcggcggtgtttcggggcgtgctcatgacgtaaacctaccttctggtaggcaggccgtcaagcagccacaccacaccgccccggctgcggggaatgtctcccgtgattgtatccatttcagacacagtccggccgaaactggctgaattgtgggatggggtggtcggatctatcttcctctcaacggtcccgcggtggacctcccgcaagcaggggaaacaggatcatgaccaccatcattcgtcgtgcagaagaccggggccatgtcgatttcggctggctgaacagccatcacagcttctccttcgggcattatttcgacccgaaccacatgggcttcggcccgctgcgggtgatcaacgacgaccgggtcgccccggccggcggtttccccacccatccgcatcgcgacatggagatcatctcctatgtgctggagggcgggcttgagcatcgcgacagcctgggcaccggctccgtcatccgcccgggcgacgtgcagcggatgaccgccggcaccggcatccggcacagcgagttcaacgcctcgcgtaccgatccggtgcacttcctgcagatctggatcatccccgaggccgaggggctggcccccggctacgagcagaagacctttgccgaggccgagaagaccggccggctgcgcctggtcggctcccgcaccggccgcgagggctccatcaccatccatcgcgatgtcgatctctatgccggcctgctgcccgagggcacgaccaccagccatgatctggcggcgggccgcatcgcctggatccaggtcgcccgcggcacggtgaagctgggcgacgaggtgctgaaggaaggcgacggcgccgccatcgccggcggccgcatcgacctcgccggtctcgacggcgccgaggtgctggtcttcgacatggcggcgtgacgccgaggcatatcagggcgcccgcttcggattgcgcaatccggggcgggcgtcttcttgcgtattgcgggccacgatccggaccgggggcttcgaaaatcggccgcgacgggtcatgaatggaattgaagcgcggcgacccggcttacatagtgtggtataccgtgcccgccgtcccctggggccagtctcaggggcggtacacaagaagcccatatgcgcgcccgtctccgcgcgcgccgcgtccttgaggatcccccatgcccgcctatcgttcccgcaccaccacccatggccgcaacatggccggcgcccgcggtctgtggcgcgcaaccggcatgaaggacgaggatttcggcaagccgatcattgccgtggtcaactccttcacccagttcgtgccgggccatgtccacctcaaggatctggggcagatggtggcgcgcgagatcgaaagcgccggcggcgtcgccaaggaattcaacaccatcgcggtcgatgacggcatcgccatgggccatgacggcatgctgtattcgctgccctcgcgagagctgatcgccgacagcgtcgaatacatggtcaatgcccattgcgccgatgcgatggtctgcatctccaactgcgacaagatcacccccggcatgctgatggcggcactgcgcctcaacatcccggtggtcttcgtctcgggcgggccgatggaggccggcaaggtggtgctgggcggcgagaagaaggcgctggacctggtcgacgccatggtcgccgccgccgacgaccggatttcggaagaggatgtcaaggtcatcgagcgctcggcctgcccgacctgcggatcgtgctcgggcatgttcaccgccaattcgatgaactgcctgaccgaggcgctgggcctgtcgctgccgggcaacggctcgacgctggcgacccatgccgaccgcaagcgcctgttcctggaagccggccatctgatcgtcgatctggcccggcgctattacgaacaggacgacgccaccgccctgccgcgcggcatcgccacccgggcggcctttgcgaacgccatgacgctggacatcgccatgggtgggtcgaccaacaccgtgctgcacctgctggcggcggcgcaggagggtgaggtcgatttcaccatggccgatatcgaccggctgtcgcgccgggtgccggtgctgtgcaaggtggcccccgcggtcagccatgtgcatatggaagacgtccatcacgccggcggcatcatggcgatcctgggcgagctggaccgcgccggcctgttggacacctcggtgccgacggtccatgccgagacgctgggccatgcgctcgaccgctgggacgtgaagcggaccactgccgcctcggtgcatgatttctaccgtgccgcccccggcggcgtgcccacccagaccgccttcagccaggatcgccgcttcgacgcggtcgatctggatcgcgagaccggcgtcatccgcgatatcgaccatgcctattccaaggatggcggcctcgcggtgctgttcggcaatatcgcgctcgacggctgcatcgtgaagaccgcgggcgtcgatgagtctattctcaccttcaagggcccggcgcggatcttcgaaagccaggatgcggcggtgtccggcattctgggcggcaaggtttccgccggcgacgtggtgctgatccgctatgaaggcccgcgcggcggcccgggcatgcaggaaatgctctatcccaccagctacctcaagtccaaggggctgggcaagacctgcgcgctggtgaccgacggccgcttctcgggcgggtcctcggggctgtcgatcggccatgtctcgccggaagcggccgaaggcggcgccatcggcctggtcgaggaaggcgacatcatcgagatcgacatccccggccgccgcatccatctggcggtggacgacgagaccctggcggcccggcgtgtcgcgcaggaggccgcgggctggaagccggccgaaccgcgcagccgcaaggtgtcgaaggcgctgcaggcctatgccatgctgaccaccagtgccgcccagggggccgtgcgccggatcccggccgcggactgatcgatcagcctgaacccgaccactgcgagccccgccatcgctgccgatggcggggtttcgtttgtccggccggtggatcatcctgcgatatgtataggcaattgacgtcgggtgatccgctgtgctgctatgagtttatgcaaagcaaagacccgcggcccgatccgcgggcacaggggtgaccgggtcaggaccatcagcgtccgttcacatacgggggaccagttcatgaagcttcgtcggaacatcggcatggccgccgccatggccggtcttgcggccgtggcgatcgccgcgcctgcctccgccgagaccactaaggtgaccatcggcctgtcgggctggaccggcttcgcgccgctgacgctggcgaaagaggccggcatcttcgaaaagcacgggctggacgtcaccctgaagaagatcccgcaggccagccgccatctggcgctcgcctccggcgacattcagtgcgcggcgaccacggtcgaaacctggatcgtgtggaacgccaacggcgtgccggcgaagcagatcttccagatggacaagtcctatggtgccgacggcatcgcggtgcgcagcgatgtcaacggcttcgccgatctgaagggcaagaccgttgcggcctcggcgcccggcacctcgccctatttcctgctcgcctggatgctgcacaagaacggcatgaagatgtcggatgttaaggtggtgaacatggagccggggccggcggcccaggccttcgtcgccgaccagaacgatgcggcgatgacttacgagccctatctctccaccgtccgcaacgcccccgacaagggcaagatcctggcgaccacgctagattatccggcggtgatggataccgtcggttgcaccccggccttcctgtcggaaaaccccgccgccggcaaggcgctcgccgacagctatttcgcggcgcttgagatgatcgcggccgacaaggacaaggcctatggcatcatgggcgccgatgtgaagcagaccgccgaggccttcggcaattcggcgcagtatctgcgctggcaggacaaggcggcgaaccaggccttcttcgagggcgagttcaagaccttctcggccgaggcggccgacctgctgctcgaaatcggcgtgatcaagcagaagccggatatcgacgcgatcgtcgacaccagctacatcaagtgacgaacggcaggtgatccgcggcggggcaggggcatggctctccgccccgcccatctgctgcctccgtcgctttttctttccgacccaaagacctggttgaaccccatgctccgacctttcgagccggtcagcccgcgcacgcggatcctgctcggcatcggctttttcgtgctgttcacggccggctgggcggtggcgaccttcggcggcttcgtctcgccgaccttcctcgccgacccgctcaccatgctcgccgacggctggtcgctgctggccgaccagggtttcctgtccgatatcggcatgaccgtctggcgggtggtcggcgggtttgccatggccagtgtcatcgccgtgccgctcggcatcgccatgggggcctacaaaccgatcgaggcgctgttcgagcccttcgtctcctttgcccgctatctgccggcctcggccttcgtgccgctgctgatcctctgggccggcatcggcgagatgcagaagctgctggtgatcttcatcggctcggtcttccagatcaccctgatggtggcggtgcaggtcggtgccacccgccgcgacctggtcgaagcggcctatactctgggcgcgcgcgatcgcggcattctccgccgggtgctgctgccggccaatgcccccgacatcgccgagaccctgcgcctggttctgggctgggcctggacttatgtcatcgtggccgagctgatcggcgcctcgtcgggcatcggctacatgatcatcaattcccaggcgctgatggccaccggccagatcattttcggcatcatcgtcatcggcgtgatcgggctgatttccgacgtgctgttcaagctggcgaaccgccgcctcttcgcatggcggctggcatgagcggcgggctgatcgtcgagaacgtcagccgcaccttcccgggtgtgcgcggcggcaagccgacgctggcgctccagcccaccgatctggtggtgccggacaacgacttcgtctcggtgctgggcccgtcgggctgcggtaagtcgaccctcctgcggatcatcgccgggctcgaccggccgtcgaccggccgggtgacgctggacgggcgcgagatcaccggccccggcgccgatcggggcatggtctttcagtcctacaccctgttcccgtggctgaccgtcgcacagaatatcggcttcggcctgcgcgaaaagggcatggccgaggtcgagcggcgcgagatcgtcggccgtttcatcgatcaggtcgggttgcgcggtttcgaaaaccactggcccaaacagctctcgggcggcatgcagcagcgcaccgccatcgcccgtgcgctggccaacgatcccaagatcctgctgctcgacgaacccttcggcgcgctcgacaaccagacccgcggcctgatgcaggaactgcttctcggcatctgggaaagcgcccgcaagacggtgatcttcgtcacccacgacatcgaagaggcgatcttcgtgggctcgcgcgtcatcaccatgtcggcccgcccgggccggatcaaggcgatcacccccgtgccgcttgcccatccgcgccactacaccgtcaaatccagccccgaattcagcgaactccgcgcgaagctgaccgaggagatccgggcggaggcgatccgggcggcgggggatcattgattgcagcccctgttacaggggggacttgtcgtggggtgcgggcgcgcttattgtcattcaagtgaatgacacccggcctctcgcggcaggaggatagaatggcggtcacggctctggttcaggcgcgcatcgacgccgaggtgaaggagaaggcgagtgcggtgctcgacggtgtcgggctcaccctctcggatgtcgtgcgtatcgtcctgacccgggtggcgcgggaaggggcactgccccccggcctcgtcaccgatccggccacccatgatgcctggttccgcgcccgggtgcaggaggcgctcgacgacacggccggcgatctctctcatgacgaggtgaacgcccgtctcgccgcccgccgggaggcagcgctccggcgggccggcggcgcgtgaggatcatctggtcccgcttcgcggccctggaccgcgagcggattttcgaccgcatcgccgcgcatgatcttggcgcggcgatcggtatcgatgaacgaattcagcagcagtcgtcggatctggcccggttcccgcagcggggccggccgggcaggatccccgggacccgcgaactggtcatccacggcacgccttacatcctggcctatcggccgggtgaagagaccgtccggctcctgcgcctgctgcacggcgcccagctctggcccgacgagctggagtgaccgcccgtcgggtaattgccgccgtcacttccgtcccgcctcgatcatcgtccgcagcggctcggccgcaagggcggcttcgatcttttcccggcccggggtttcgggcagggcctcgcgcagattgcgggcatgggtctcgggcaggcgcggcggcatcatcggctcgtaggggtcgacgatcgcatcgatgaccaccgggcccggggtggcgagcgcctggtccagcaccgcatccacctggccgggttcggacaccgtgaagccgcgcccgcccatggcctcggcggctttggcgaaatcgatcggctgcagctcgcaggcgaattgcgggttgcccaggaacatcatctgctcccaggcgatctggttgagcatgccgttgcggatcaccagcagcttcaggttcagcccgtggcggacggcggtggagaactcgcccagctgcatggcgaagccaccatcgccgacgatcgcgaagaccgggcggtcgggatgggccagcccggccgcgatcgcatagggcaggccgcaggccattgaggcgagcgtgcccgagacggcgtaatcctgccctggccccagcggcacgtggcgggcggcaagctcggtgttctggccgctgtcgctggtcaggatcgcctcgggcggcagccgccggcccagcgcccccaccaccacctgcggcttcatcggcacgtcgtcctggcgttcggccgcgcgcatcatctcgcgccaacgcgccatgccgctctgtgcgcgttccaggaagctgcgatcctgcttgcgctccagcttttcgttcagcagatgcaggctttctgccgcatcccccaccagcccggcctcgaccggatagcgcaggccgatgcgctcgccgtcgcgatcgatctgcacggcgcgcgcctggccggggtcgggataatattcgatataggggaaggtcgatcccacgatcagcagggcgtcgcagccctccatcgcttcctcggacggcagggtgccgagcatgccgatgccaccggtcgaatgcggatggtcctcgggcaggatcgccttgcccagcagcgccttggcgaccggggccgccagcaggtcggcggtcttttcaagctctgaaaccgcaccggcggccccctggccggccaggatcatcacccgttccgcccggttcaggatcgaggccgccagctccacctgatcgggatctggcaggctgcggccgtaaaagcgccggttcggcacatggcccggccggttgcgcgacgaacgcgggctgtcttccagcctctgcacctgcatgtcggccgggatcgacagatgggccacgccgcgccgggtgagtgccgcccggcaggcgaggcccgccaccgtctccatatgtgcggcgctggcgaccttggtgtcgaagaccgcgatgttgccgatcatccgcgagaggtcgatgtcctgttgggtgaagctgtcgatcaggtcatgggcctgcaggccggtgatcgccagcaccggcgcctgatcgagcgccgcatcgcacagcccggtgatcagatgagtgccgccgggaccggaggtcgccaggcagacgccgagctttccggtgaatttggcatgggcggacgccatgaaggcggcgctttcttcatgccgggtctggatgaagcggatcctgtcctgacgggtgcgcagcgcctccatgacgccgttgatgccgtcgcccggcaggccgaagacggtgtccacctcccaggcgatcagggtctcgaccagaatgtcggcggcggtgagggcaggtgagggggcggtcatcgggcgatctccgatctgcggggatgtcggaaggcgaacgcgcgggcgtaccgcatgttccattgaaaccttccggcgactccggcgtttgcctgtcgtgcccgtcgtcccgagcccgccgtcccgagcccgccgtcccgagcccgccgtcccgaggaggccccatgcccgacacccagcgggcagagattgcccgcgcggctctgccccgcgcgcctgaattcgatgcgaccctcgccctgctgcgagaaggcgccggctacatttctgcccgcgccgatcacctggggaccgacgtcttccgcaccaggctggcgctccgcccggtcatctgcatgcgcggcgccgaggcggcggagatcttttatggcggtgaccgttttacccgtcgcggtgccatgcccgcctccatccgccatctgctgcaggatgacggcagcgtccaggggctggacggggccgcgcatcgccaccgcaaggcgatgttcaccggcctgatgctggaggactcgatccgccgtctcgccggccatttcgctgccgaatggcgcagcgccgtgccgggctggcagacggcgggcagggtggtgctggtccgcgccctgccgcagctgctgttccgcgccgccgcggtctgggcgggcgtgccggtcgacgatgccgaagcgacccgtcgggcggacgagatggaggcgatgatcgtcaatgccggccggctcggccccgccaactggcgggcgcggctgcgccgtcaccagaccgaagcctgggcgcgccgggtgatccgcgatctgcgtgccggtgcggcggcggagctgtcgccggccctgccggccgccgccatcgccgcccatcgtgatgaggccggccggctgctgcccgaggccgtggcggcggtggagttgatcaacctgctgcggccggtggtggcggtgggtcacttcatcctgtttgctgctctggcgctccatcatcatcctgaatggcggacacgcttcgccacgggcgcggacgaggatcttgagcccttcgcgcaggagatccgccgcaccacccccttcttcccggcggttgccggccgggtgctgacccccttcacctggcggggcatcgatttcgcggccgatgcctgggtgctgttcgacatccacggcaccgatacccatccggccctctgggccgatccggccgccttccgccccgaacgtttccgcggctgggatggcgatccctggcgcctggtgccccagggggccgggctggtcggggcgacccatcgctgcccgggggagcggatcacgctggagctgatcaaagaggcggtccgtctgctctgccgcgatctggactggcggctgccgccccaggatctgaccgtcgatcccgcccgcctgccggcctgcccggcggacgggctggtgctggccgatctcaggccgtgccgctgaccaccccgtcatgtcatcggaaaggacgacccctatgccgtctcacatccacggttttgccgcagccctcgccgcgacgctgatgatcgcggccgcccccgctatcgccgccgaggcagagaccacccgagcggacgcgcggttcatcggcctctcgggtgaggaaaccggcaccgccaccctcaccggcaccgcgcgcggcgtgctgatccaggccgaggtgcgggacctgccggccggtcagtgggtcgccttccacattcacgaaggcggtacctgcgatgcggccgatcaccacaaatcggccggcggccatttcaacccgggcaacacggcccatggtttcctggccgaaggtgggccgcatgccggcgacatgcccaaccagatggtcggcgccgacggcacgcttcatgccgaggccttcaacccgatggtccggctcgatgacggcccgaacggcatccgcggccggacgctgatgatccatgccggccgcgacgaccaccgcagccagccttcgggcaatgcgggcgaccggctggcctgtgcggtgatcgagtagtcgggcagctgcaggcacgcagagccggagacggttgcgcgccagcccgggctgatgccggaccaccacgtccggtgtggtgaccgagaccgccggcatggcggcggcggagatctgccgcaaccggccttccagcctgaagatcagggcccggccggtgccggtgcggcagaccaggcgcatccggctccggccgacctgaacgcagcagcgccgcccgttcacggcgagatagagccggggccgacagagccgggccccgggtcgcgcctggcgcggcaggtcgcagaggcggagcaggcagagaggcagccgcgcgccgccgagctgcgccgacgtctcgacgggcaggcggaaatgaagcaccacccctcgcgtctcgcccgtctccagcggggtcggtggaaacatctcgatctgcagatccccgatctctgccaggtccgccaccgggggacgaccgcatcccagaggctgggcctcgacgagtatgggcgtgcgtcgtaaaggcctggtcatggtcttgcctcctgtcgtcagcgggggaatgcatgcgagcaggttaacctatggttcacatatattgcatgcaggattgtgttgccgcatgcggacgaatgttgcctgtcgacgcccgtgaacaaatcaaacatgataaaatatttttggaatgggcactcgttcggcgagaaatgatcgctctaattagaatttcagcgtgtatttcaatcactggtgacggaagcgggggacaaatcgttgcaaaattggtcaaatgcctcagacacgaaatctgccggccgcggaacggccgggatctgcggtgtggagaggcaaccgacacatgagcacgacgaacccgaccggccggcggccgaatttcctgttcctgatggtggacgagatgcgccacccgccggtttacgaaagtgaggcgacccgggccttccgcgccgcccatctgcatattcagccggtgctgcggcagaacggcgtgaacttcacccgtcactacgccgcctcggtcgcctgcgcgcccagccggacctcgatgttcaccggccagtatccctcgctgcacggtgtcacccagaccacgggtgcggccaagtcggcctcggacccgcagaccttctggctcgatcccaatggcgtgccgaccatgggcgcctggttccgggccggcggctatcgcaccttctggcatggcaaatggcatgtatccgatgccgatctcgccacgcccggcacccataacggcctgccgtcctataccgccgacggggcgcccgatccgcagaaggtggcgctttatcgtgccgcgaaccggctggatccctatggtttcgacggctggatcgggcccgagccccacgggtcgaacccgctcaacagcggctcgtcggccaaggatgcccgcggccgcgatgtcgcctatcgcgacgaggtggtggcgacgctgaaggcgctggatgcggcagaggacgacacgccctggctgatggtcgcctcgttcgtgaacccgcacgacatcaccctctatggcctggccgcccgtctcggcggcggcttctctttcccggtgggtgaggacgtgccgaaggatctgttcgacgacagcttcaaggcctcgcgtttcgaggatctctccaccaagccctccgcccaggcgagctatgccgagagctaccggcagtggatgcagccgatcgtggacaaggaattctacgagcgcctttattatcagctgcagcagacggtcgataccgatctgatggccgtctacgagacgctgatgcagacccgctttgccgaggacaccatcgtcatcttcacctcggaccatggcgacctgctcgatgcccatggccatatgcaccagaagtggtacacgatgtatgaagaggcgctgcacgtgcccttcatcatctccaaccccaggcttttccccggcggggccgaggtcgacgggctgaccagccatgtcgatctgctgccgaccatgctgggtctggccgggctggatgcagaccagctgctcacatcgatcgggccgcgctataccgatgccatgccgctgatcggccgcgatctgacgtccgcgctggtcaaccgcacgccgctgaccgacccgatctatttcatgaccgacgatgatcccagccgcggccccaaccaggtcaacttcaccggcatcgcctataactcggtcatccagcccaatcatatcgaggcggtcatcgtggcgggagaggacgggacgctctggaaatacgcccgttatttcgacaacccgcagttctggagcacgccgggccggccgggcaatcccaatgtcaatgttgaggacatcgtgaccagcccggtcggtacgccacccgacaccgacggcactacccagtggccctacaactacacggtcaagcaccagccgctggccgaggaatacgagatgtatgaactcagcgccgacccgctggagctgaacaatctggccggccagccgcaatgggccgagcgtcaggcacagcttgccgcattgctggccgaacagagcgccgccaagcgcacagtcccccagagcggccgcgtgcccggccagcccttgccgatcccggccggccagatgggctgaagcgccggtcaggtcaccaggaagtcggcggcggtgagcgccaggcccttgcccaacagggcgatctgcaccgccgccgatccggcgcgacgtcagccgcccgacggatagtcggcgtccgacaccttttccatccaggtgacgaccgatccgtccagcgcctcggcgatggcgaaatgggtcatggcggcatcgggggcggcaccgtgccagtgccgggtcatgggcgggatccagaccacatcgccggggcccaccttcaggaccggcccgccgtctttctgtaccaggccgcggccttcggaaatgaacagcgtctggcccagtgggtgagtgtgccaggcggtgcgggcgccgggggcgaatgcgacggtggccccgccgatccgggcgggggcgtcgccctgataatggccgtagaccttcacctcgccggtgaaatacgcgtcggggccgggtgtcgcggtctcgggcgcggccgggatcacccgcagatcggtgccggcagccgcagcggctgcacgtccggcgaacaccttttccagcaccggcaccgcagacatcgcccgcggccagccggcatagaaggccagatgggccggcacttccgcagcctcgtcgcggctgaggccgttatccatggcgcggccggcgtggaagggcagctgttccggctgaccgatggcgatcagcgccgccatggtgatcaggctgcggtcgcgcggcgccagatcgggccgctgccacagatcgccgaacagcacccggttggtcaggtcggcgagggccggggcggtcgggccgaccgcgccgtcgacggcggccttgcgtgccgcttcggcagccgcttccagctcgatgcgcgcagctccgctctcggccaccgggccgatgctgcgctgctcgaacacggtgcgtgtctcgaacactgccgaaatggcggccggccagccggcatagaaggcgagctgggtgatcagctcgccaatctcctccggtcggacgccattgtcgagcgcgcgcgcgacatgggcgccgatctgcgccgtccgcccggtagacaccagggctgccagggtgatcaggctgcggtcgcgcgggctcagcaccggccgggcccagacttcgccgaacagcaggtcgtcggtgaaacggccgagcgccggtgcgacctcgtagacgggggcgggggcaatcctgcgcctctcctcctgcgcctctgcaccggtggcggccagcgtggacagggcgattgtggcggcgatcttcttcatgatcctcgtgatcctccggcatcggtcgggcggtggcgggcggcaaggccatacgccacacgattgccgataagctgggggcatggggatccagcgattaggcgatcagatccgcacaggctgatattgctgattcatgaatggccgggtcatgaagggcgggcggcctgtgcccgcagcgcatcgaccagcagccggaaggcgaccgacacctggcgccggcttggataatacaggtggtagccggggaagggcgggcaccagtcgtccagcacccgcaccagccggccctcggcgatcaggctgccgaactggtcctcgggcaggcaggcgaggcccagcccgtcgagtgccgcccctacgatcagcggcgtgtggtcggtggtgaaccggccggtgacgcgcacattgagcggccggccctccttctcgaactcccagacataaagcccgcccagggtcgggagccggaggttcaggcagtcatggccggtcaggtcgtggggagtgcgcggcgccgggtggcgttcgaaataggccggcgaccccgccaccgccatgcgcagatcggggccgatcctgaccgcgatcatgtcgcgatcgacctcttcacccagccgcaccccggcgtcgtagcgttcgctgacgatgtcggtcaggcgctgatcgatcgagatttcgatctcgatccccggatgttcggcgatcagccggttggtcaccggcatcagcaggtccatggccgcctggcggctggcggtgatccggatcgtgcccgtcggccgttcgcccagcacgctcaccgcccggatctgcgcctcgatgtcgtcgaaggccgggcgcagggtcgccagcagctgctcgcccgcatgggtgggtgcgacattgcgggtggtccgggtcagcagccgcacgcccatgcgttcttccagccgccggatggtgtggctcagtgccgattgcgacgtgcccatccgcgccgccgcccgggtgaagctgcgctcttcggccacggctacgaaggccatcagatcgcccagttcctcacgcttcattccggtctcccctcgtacctgcccggccagaatatatgagcgagcgacataggtgcataccgatctgatgatctaatcgcacggcgcggcaggtgctatgtcgtcaggtacccggccatgcccgtcatggccaccctcgggaaaggacctgatcccatgctgggcaccgtactccacgcccccggcgacgtccgttgcgaacacgtccccgagccggaaatcctgcagccgaccgatgcgatcatccgcctggccgccagctgcatctgcggctccgatctctggccctatcgcgggctgaacgacatcaccgcccccatgcatatgggccatgaatattgcggcgtggtggtcgaggtgggtgccgcggtcacgaccgtgcggcccggccagttcgtggtcggctcgttctgcctgtcggacaacacctgcccgcattgccgccacggctttcagtcgtcctgcgaccagcgcgaattcatgagcggcgcccaggcggtgttcgcccgggtgccgctggccgacggcaccctggttgcgacccgggacatgccggccgacgatctgatccccggcctgctcgccgcctccgatgtgctcggcaccggctggtatgcggctgatgccgcgcgggtccagcccggatccagcgtggtcgtggtgggggacggtgcggtcgggctgatgggcgtgctggccgcaaagcagatgggcgccgcccgcatcatcgccatgagccgccacaagacccgccaggatctcgccctgcattatggcgccaccgacatcgtcgccgagcgcggcgaggccggcatcgcccgggttcgtgagctgaccgcccgcatcggcgccgatgcggtgcttgaatgcgtgggcacgcaggactcgatgacccaggccctgcgcgtcgcccggcccggcgccatgatcggctatgtcggcgtgccccatggcgttgaattcgacggccagcagctgttcttctcgcaggtcggcatgctgggcggcccggcgccggtccgccgcttcctgccccatctgatggatctggtgctcagccgccgcatcgatccgggcctggtcttcgacctggagctaccgctcaccgacgtcgccgaaggctatcgggcgatggacgagcggcgggcgatcaagaccctgctgcgggtgtgatgccacccgtcagactgtcggcaccgtaccgccgtcgacggtgatctcagtgccgtggatggccgaggcgcggtccgactgccaggaaggcgatcacctcggcgacctcgtcggggcgggcggggcggccgatcggaatgccacccagggcgtcgagaatgctctggcgtgccgcttcctcggtcgtgccggccccggcggcgatccgtttgaccatggcatcggcggcatcggtatagatccagccgggcgataccacattcaccctcagcccgcgggggccgacttccttcgaaagcgccttgctgtaggtgaccagggcggccttcgccgcggcataggcgatggtcgcgtcatgcagtggcagacggtgctggatcgatgcggtgtggatgacggcgccccggccgcgcgcgatcatgccgggcagcagcgcacggtcgagcctgaccgcgctcagcaggttgaggttgagttcggccagccagcaggcatcgtcgagcgccataaacccgccgcccggcgacccggacccgcccagcacatgcacgatgatatcgaccccgccgaggcggtcgatggccgcctcggcaagggttgcgaccccttcgggcgtcgtcagatctgcggcgatgaaggcctcgggcggtacgaaatcgggccgctccgaccgggcggctgtgatcagcgcggcaccgccggcggccagtctctgaaacgtcgccgcgccggcgcctttggttccggcggtgatgaccacgcgcctgtcacggaattcggagggatcgatcgacatcatcaggcggtctcctttgggcctcggaggtgattgaccggttccgatatgtcgctaagctgaagaaaaaggaagaccgcacaaaaaagtgagggacttacttatgagtaagcggcccgactacacgccccatagcggcgcgcagggcattcagaacgccttgcggattcttgaagggcgctggaaactggtgatcctgttccagttgttcggcggcaagaccctgcgtttctcggaactcgaacgctcgatccctggggtgtcgcagaagatgctggtccagcagctgcgccagctggagaccgacggcgtggtccggcgcatcgtccatgccgaggtgccgccccgggtcgactactgcctcaccgactggggtcagtccctttgtcctgcactcgatgcgctcctgctctgggcggaagcggcgccggacgacatccgcgcgcagctgatcccgtcgcccatgcccgcctggcccgcctgacccgcctcggcggcggcgtcgcggcaggcgcctgagatccaggcggtgaaggccgccatggcccggctctgcggccgttccgacggccaggccaggaaatagtggccggccggcacggtggtggcgaagggctgcgtcagccggccctggcggatctggcggctgaacatggcgatcggcagcagggcgacgccgaagccgtcggccgccagttccgcaagcgccaccgagctgtcgaagaccgggccggtgaccggcggggcggggatgccggcggcggcgaaccattgcggccattccgcattgcgataactgcgcagcagcaccgcccggcccagatcggccggatcctgcaaccgcgccgccagcccgggggcgcagagcggcgacagcggcgcctcgatcagcggcacggtttcatgcccggtccagccgccggtgccgaagcggatcgccatgtccagcccttcgcgcagaatttccacgcggttgttgttggtggcgatgcgcagctcgatctcgggatgggcggcacagaacccgtccagccgggcggtcagccagcccagggcgaaggtggtgttcacgccgacattcagcacctcgacatcgcgccggccgtgcagcctgtccagcacccggccgatggcgtcgaaactgtgttccaacaccggcgccagaagccgcccctcatccgtcggcaccaggccttgagaggtgcgctggaacagggtggcgccaagcagatcctccagccgggcgatctgatggctgaccgccgcctgggtcacgcgcagttcgatcgccgccttggtgaagctgccctggcgcatggccacttcgaagacgcgcagcgcgttcagggggatgtccgggcgatccattgcataacctcagcttatggcggtcagcaggatttgtcggctgggccgccgatgcaagccggattaagagaacggcataagaaaatcttgaggagatctcatgatgccgatcgctcttccgcgtctgccgcgtcttgtggcgggcctggccctggggctgtttctggcgatgcccgcctgtgccgacacgccgaagaccccgacgcccgagacccggcttgccgacaccgtcagccgcatcgaggatcagctcgatgcccgcatcggcctcgtgctgcacgataccggccgcggctggcgatgggggcaccgcgccgatgaacgcttcctgatgaacagcacggtcaagatgccgatctgcggcgcgattctcgccggggttgatgccggaacggtctcattggacgaaaccctgcccatccgccgggccgatctcgtctcccatgcgccggtcaccaaaccgcgtgtgggcacggcgatgtcgatcgccggcctctgcttcgccaccctggaccagagcgacaaccccgcggccaatcttctgatcacccgcctcggcggcccggccgcggtcacgcaattcttccgcagcatcggtgatccggtcagccggctggaccggctcgaacccggtctgaacagtgcgccggccggcgacccccgcgacaccaccaccccggcggccatggcggccaccatggaaaccctgctgctcggcaccggcctgaccccggcgtcccgggcgcagctgaccgaatggatgcgccatggtggcgtcaccggcgccctgctgcgcagatccgccccggccgactggcagattgccgacaaatccggtgccggcgacaccacccgcaatctggtggccctgatcaccccgccgggccgggcgccgtggatcgcgacgatctatctgggggatgccgagacggatttcgcaacgcgcaacaaggccctggccgagatcggggccgcggtcgtcgaggtggtcagggcaccctgacgctcaccgccggcccatcccctccaggaagatcccctccaggaacaggcccagcagatgggggatgcgcgtctgtgacgcctcgtcctccccggtggcgagggaaatggcggtcaccacgcagaccagatcctcgaagctcacatcctggcggacggcgccggcggcctgcgcctgatgcagcagccgccggccttccgccgtcgtcgcatggcagccgggcgttccgctttgcaaaaccgtaccgatcgaggtggcgaggccgcgatagagcgtcgtgtcggccgccaggtcttcgagataggccctgagcgcgccggcgggatcgcgcccgtcatcccgcgtccggctcgtctcggcaagcgacaggaaacgggcattataggtggcggccagcagctcctcgcgcgtcgggaaccggcgatagagcgtgccgatgcccacgccggcacgcttcgccacatcctccagcgcggcaccggcgccctgttccagaaacaccgcctcggccgcggccaggatgcgctcgcggttgcggcgggcgtcggcacgcagggtgccctcctgctgcatgccctcctgctgcatggtctcctcgctcacggtcttctccgaaggtgcttgctaaatggaggatgcctccatattttaaatggagcaatcctccacttatgacctgaggtatggatatggcacggggatctgagagccggtttgcgaaccgggtggtggtggtgaccggcggcagtgacggcatcggcctggcgaccgcgacgcagttcgccgccgaaggcgcgcatgtctacgtgaccggccgtcggccgtcggctctggatgcggcggtcgcggcgatcggcaacggcgccgtcggtgtgtcgggggatgtcgccgacccggcggatctggaccggctctacgaccgcatccgccgcgaccatggccgcatcgacatcgtcttcgccaatgccggcatttccgaatccgccggcctcgacgccatcgacgcggcccatatcgaccgcctgttcgacgtcaacctcaagggcacggtcttcaccgtgcaaaaggccctgccgctgatgacggcgggcggcgccatcatcctcgccggctcggccgcgggcagcaagggcctgccggggctctcgatctacagcgccaccaaggccgccattcgctccttcgcccgcacctggaccaccgacctcaaaacccgcggcatccgcgtcaacgtggtctcccccggcatgatcctgaccccggccatggacagatacctcaccgccaaccccggcaccgaagacgccctgaaacagatgacccccttcgcccgcctcggcaccgccgaggaggtcgcaaaagcggtgctgttcctggcgtcggaggacagcggttttgtggcgggggatgagctgttcgtggatgggggggtgatggcggtttaggccgcagatatcattacctgatcgtgatcacggctggagcgcgacatccccgtcaatctcggcattgaggtcgacgtccatgtccccgacaagtgccgcaatgcgatcgcgcaggctggcgggcagtgcggcgatggatgtgcccgggtgtttgcgcatgtcctgcgccagaaatgcgaggaagcggtccacgaccggatcgcttgcctcttccattactttctcgacataaacccgatgctgatcgtccacaaagaaggcgatgcgtccgccgtagtccacgcccaaagcctgtcgcacgctcttgggggcgccgacacctgctgccaatcatgccaagcgcggaacatcagataatcgcctgcaaccccttgtccgcaatgacgttcagcagcttgagcgcggggccggtggggcgggttgcgccctgctcccacttgcgcacggtcgacgcggtggtgtgcaggtgatgtgcgaacatcggctggctgaacttcaggttttcgcgcagacgctttatgtccatggggctgaactcccgaaccggggccgggcagatcgtgccgaacgcgcgcagcgtcaccttattgatggcgcctgcgtcgtagagcgcagccaggtcctcgcgcagcgattcaacaattttgctcacaatgcacctccaccagaacacccgactgtaacgccttcctttttcattttttgtggcgactgcctcgctctctgtcaaccaaggcgagaaacaatagatccggtatgtccgagccgccagaagcatccgatttcgccatgttgagggcgttagaactcgtgaggaaaaattcgcctctatttccgatccgtggcgcccttgctgtttgcagtggtttgggagggtgattggatgtgaagtttttgcagaatcccgtcttctgtctgcatgttgtaaaatgcggttggcgcgcttacattccagtctgaaaatgcatcttttgtctcctcccacttgctgattgatccatatatttggatatacatgccaccgaaccgtatcgcatgaattctatcggctatcttgagtgcctcatgcatgtgtttacctcctaaagaaaatgcatatccagatgatgttccggaaatgccgataactagtagtgattttaaggccgaaagcaccataaaatttgcggtgatgtcttgcaccgaattaataaggcgtatcatttgttctccaacaaaatatatgcagaatattcctacgaatagcgacaaaactccgataaaattccaaatctttgaccatgcaacaagcattttctcgcgatctctgagttcatcaacggtgtctttaacataatctgatgaacgttctcgaagtttatttgatatttcttcattatatttttgtcgctcgctttccgtctgacgccgtgcattttccagagatttttctgaatctgacttctcttttgagaattttgctttctcgatgcgtaattcacgtctttcctgatggagctgctcctttaatttatttatctcctcaaaatcttccatatacgatttctttccatcttcatacgcccttataagattacgtttatattcatctttatattcatcttcatgtgaagaatattctgtgggaattcgaagtgatttactatatgtgtgccggttaactccatgagattcgggtatttttgtttctgatgttctgttcatggggaaatcatcttcttgggtactcattgcgaatctccagttgcgagcgagataaattggtgtgcagattatttgcccagctgatttggaagatgaacgcacacagtaacataatccggctcaacgtcaggagaaatcaagtctaattatttaattgatcagcggtcagcgaccaaagccaccgaccggacttgtcaggtctgaaccgttacccgtccagtcgatttggaccccaggcacccctcaccccccatccctcttaatccgcatcgtataactataccgatccgccggatgatcattcaccgaggcgatcagcggccggcccttgcggtccagatagcggcggaccacgcgcaggacatgggcttcggggcggtggtcgtcgaaaagggtgcggctttcggggggcatgggcagggcggtgatggtctgcagggtttccgtcaccgtaacccgggcgcgctgttcgatcagggcgtagaaggggccgtggcagttggggaattcgtcctgcagccaggcgaagcgttcgggtacgaagacttcggtatagctgatcggcgcgccgtcgccctgggcggagcggacgccgtggatgtgcagccagggctcggccggttcggtgccgatcagtcgggcggtgggctcgtccagccgttccatcgccatggcgtggatgcggaaatcggtgtccagcgcatactggaagagttccgacagcgaccgcatcgactggctgaagatcgagcccggctcggccgagagcacatgggtgcccgatccctgccggcgctccacatagccctgttcgaccaggcggcgcagcgcctcgcgcacggtatagcggctgacggcgaattccgcgcacagctccgcctcggtcggcaccaggctgccgaccggatagagaccgtcggaaatccggtcgcggatctcctggaaaacctgaagatagcgggggatttccgggccgtccgccgcggcggctgccgggtcccgggtcagatctgccgcctgatcctgctccatgcgcgttccagctccccttgaaattcgggcgcggccacggcgatcagacgttccgcccgcatgtcgaggttgcacccgcgcagatccgcacagccgtattcggtgacgacgatgtcgatatccgcgcgctggatggatacaacagttccactctccagaacagggacgatcctggatcgtgccccccccgcagcggtcgaggcaagggcaaccaccgctttcccgcccgccgagcggcgcgcgccgcgcaggaaatcgaccagcccgccctggccgctgatctggcggccaccgatcatctcggccgaggcctggccgaacaggtcgatttcaatcgcgccgttcaccgccaccagccggggcagggcgcccagccgggcgatgtcgtgggtctcggccaccggccggaaacgcacgccctccgcccgggcgatgcgctggtggaaatcgggcgtgcccagggccacgccggtggtgatgccgcggctcgccacccccgcctccagcagctccagcccggccgcagtgaccatgcccgcatgcagccccagatcccggtgatccttcagcgcgcggagcagggccgccggcgcggcgccgatgccggtctggatggtggaaccgtccccgatcagcccggcgatgcgcgcgccgatccggctctggaccggatcgtcacgatcgggtggcagccccgcgggcagaccgtcgctttcgatcagccccgagaaccggtcgatcgggatccggatcccgtcgagcggttccggcaggtcgggcaggatcacgccataaagccgcgcgcggccggccgccaccgccggggtgaagtcatgggccatggccagcgacaccatgccgtcgcgcggcggtgccacggtgaacagcgccgcgtcgatcgggctcgcctgcagatggtggtatgtgtcgacataggcgagcggcagatgccgtacccggccggcctcgaagccctggcgcagggccggggtcacgaaggtcgactcgaccgtcagtgtcgggtccagcgccgccagatccagccggttgacgccggggatgaacacgccggtgagtgtcttgtccctgagcgccccgcaggcgcccagcgccgtcagcacctgggcaggttcgcccgcgcagccggcggtatagatccgccgggcgggtgccagggcccgggccaggccgtcgagatcgatcaggggcagggggggcatgctgctggtcatcatccgtcactgaacgggttgcgctccgggtttcggctgctagtatatgtccggacaaatttggaagatagccctcatgcccgagaattccgatgtctgacagcgccgccagtctgcccagtctgaccgaacggctcggtctttgtctcgcccgtccggtcgatgcggctgcgcgggagcgcgcccgccttgcggtgctggactgggccggctgtgccgtgatcggggcggcgaccgagaccggccgggcctttgcgcggcttgccgcggatggggtggttgggccatcgcgggtgctgggtgcggggcgcgcccccgcccgcgacgccgccttcgccaatggcgcctatggcaatatctacgaaatggacgatgtcgaccgccaggccgtgctccatccgggccccgtggtcatcccggcggcactggccatggccgaggcgctgggcagcagccccgatgccctgctcgatgcggtggtgcgcggttacgaggcgatggtgcgtctgggccgcgccatgggccccgcccattaccgccacttccacccgaccgcgacctgcggcgccttcggggccgccgcggccgcggcctcgctgatggggctggaccaggcacgtctgaccggcgcgctcggcaccgccggcacccgtgccgccgggctctggcagtgccggcacgagccggtgaccaccaagcagttccacaccgcccgcgccgccgccggcggcatcgagtcggcacagctggccgccgcaggcctcggcgggccgcgcttcattctggaagggccgcaggggctgttcgccgccatggcgcccgacgcccggcccgacgagatcacggcgccccatgatggcgcctggctgatcctcggcaccagcatcaagccctggccggcctgccgccatgcccatgccgcgatcgatgccgcgctgatcctccgcgccgaagcgcagggccgcatgccggccgcgatcgaggtgcgcagcttcgccgatgcgctcaccttctgcgaccggcccgatcccgccagcaccatccaggccaaattcagcctgcagcacgccgtggccgtcaccctgctcggcggcccgccgccgctcggcgccttcgagcccgaggtcatcgccgatccggtggtggcggggctgcgcgcgcgggtgcggctggtggtggccgaaccctatgccggcgcctatccgcgccgtttcggcaccggcctcaccatcacctgggatgacggcaccaccagccgtgccgaggtgccggacgccctgggcgaccccgaaaatccggtcgatcatgcggcggtggtgaccaaggcccgcacgctggccagggcggccgggctggacgagcagcacatcggggcgctgatccgggcgatcgaggcccttgaaggccccgatccggcccggatcgctgccttcaccgccatcctgccctgatctttggccctcaccgtcacaccttcaccccccacatttgcgaagagacgaaagcatgaccggtcccgactatttccaggcgcccgactatttccaggccatggactaccccacgatcgtccaggcctatccggtgggggatgatttcgtcgccctggggcagcgcctcagccgcgacgagctgttcgcccgccaggacgcccagttccgtaaatgtctggccttcgcctggaaggtgccgttctatcagcggctctggggcgagaagggcatcgagcccggcgatatccggggacttgccgatatcggtaaactgccgacctattccaagaccgagctgatggcctcggtggccgcccatccgcccatgggcgatttccacggcctcgacacctatcccgccggccagcgcccgcccgtcgtcttccagaccaccagcggcaccaccggcaagccccagccgctgatctatggcgcgaagagccgcgaggtgcagaaccgtcttctggcgcgcgcctatctctggcagggcatgcggcgcgaggatgtggtgcattcggtctatggccacgggctgatcaatggcggccattacgtccgcgaggcggtgagccactgggtcggcgcgcagttcatgagcgccggcaccggcatcgagacccggtcggtcaatcaggtcatgatgatgcgcgaattcggcgccaccgtgctggtcggcttcggcgactatgtcaagcgcctggccgatgtcgcccgcgccgagggcatggagcccggccgagacatccgtatccgcatgatcaccggccatatcggtgccgaaagccgcgagagcatgagcgaggcctggggcggtgccgaggtctatgactggtatggtgtcggcgacaccggcatcattgcggggcacggtcccgatcaggacggcatgtatgtgatggaggacgcgcagtatctggagctgctcgatcccgataccggcctgccggtcgaagacggcgagctgggcgacatggtctgcacctgcctgttcaaggacgacgtctttccgatcatccgtttcaacacccacgatgtgaccgaagtgatgaccggtgcctcgtcgaccggagtcaatttccgccggatccgcggtttcatgggccggtcggacaatatggtcaagctgcgcggcatcaacatcttcccgaccggtatcggcgcgctgctgtcggaagagcgcgaggagatgaccggcgaatatatctgccgcgtcgcccggatcgagggccgggacgagatgaccgtccatgtcgaggtcagaaccggggcgggtgacgctgcgatgaaggcggcgtacgagaagatcctgcgcacccgcctgggtgtcgagatcggcgtcgcctttgcggcgccgggcgagctggcgccgctgaccggcatcgaggtgcgccagaagccgatccggctgatcgacgagcgcaagtaagcgccgctgaccgccgctctcccccgccgctctcccccgtcatcttcgccgaaagagcccacgcacatgaacgtgacgcccgtgtccgcggacctcacccgcctcaccgcaacggagcttgtcgccgcttacagcaatggcgccgccgatccgctggcggtgttcgatgcctgcatcgcggcgatccgggcgcgggatggcgggatccgggcattcatcgagctggatgtcgagggcgcgcgggcggcggcggcggcctctgccgcgcggttccgggatggctgcccgtgcggcccgctcgatggtgtgccggtggcggtgaaggccaatatcgccgtgcgcggcctcgcctggtcggcgggggtgggcttctggcgcaaccggatcgcggcggaagacgcgccggccgtggcgcggctgcgggcggccggcgcggtgatcctgggcacgctcaacatgcatgagggtgcgctcggcgccacaactgataacccgcattttggtcgttgctacaaccctgccgtgccgggctgcaccccgggcgggtcgtccggcggctcgggtgcggcggtggcggccggtttcgtgccggtggcgctcggcaccgacaccatgggctccgtgcgcattccggccgcttattgcggggtgatggggctgaagccgaccacgggccttgtctcgaataccggcgtggtgccgctcgcctggtcgctcgatcatatcgggccggtggcgcggtcggtggacgatctggccctggtcacccggaccctggccggcttcgaccccgccgacccggtggccgaacccgcgcccgccggctggacggcgatacccagcggctgcggcctgtccggcatgcgccttggcctgccgcgcgagatcgacgccgtagcgaccgagccggcggtgcgcgaggctttcgcccatgcgctggaccgtctccgcggcctgggcgccactatccagccggtcgccatccccggctggtcgccgggccccgcgcgccgcgacgggctgttgatttccgaggcagaggcagcggagctgcatcccgaactgatgggtcccgacggcaccaccacgcccgagggcgtgagcgagagcttcgccgccgccctgcgctatggccgcgatgccagcgccgcccggctggcgggcgcataccgccgcatcgccgaaatcggtgtcgccgcccgtgcggccctggccggcctcgacgccttcatcctgcccacggccccccaggccgccttcgcccatgatgcaaaggtcccggccgggcaggccgatttcaccgcgcttgcgaattttgcgaagctgccggcggtctccgtgccggttgagcccatggcacccccgacgtcaatcgatgaccagacattcgcaaacgtcgcaaactctgcgaatcctgcgaagcccccgatcggcctccagttcatcggcccccgcttcggcgaggccgccatcctgcgcatggccgccgcttacacggcggcactcggcggctccgataccgtgcacggatcgtgacaccgtaaagcgtgcggcacaccagcgccggggcgatcagacgaaaccgccatcaccgcgacaccccgcccgcgaaccccaggcacccgcaaaaaccccgggaggttcgcgcaaaccgcgttttttccgcccgcgcttcaaggtattaagagggggtagggtcgcacccttgcgggtgcgtggattgaaacggcaggtcaatgatcggcgagccctggcgaaggctccagggtcgcacccttgcgggtgcgtggattgaaacggcagtcatgtcgatcccgaagcgcatcccgaaaaggtcgcactcttgctgccgcgtgaaccgtacaagacgccgtgtcgccggcgacacagtggggattcgggcgggcaagttatgcataccccgccggccgccgtgtatgccagtcggtcgcagtctggaaggcgtgggcggtgcgggcgatcagggcttcggcgaagcgggggccggcgaactggcagccgatggggatgcctccaccgccgatacccgtctcgctgaggccgcaggggatggtgatggtcggctggcccgagacgtcgaagggggccgtgaacgggccgatcgccaggatcgccgccgggtcttcgcccaggccggacatgtaatcgagcgtggggcccgcgaccggcaggccggggatcagcagcacgtcgcaggcggcataaatcgcctccatcgccccggcgaaatcgcggcggtgctcctgcgcttcggccagttcgaacgccgtgtggcggtggccgcgttcgatcagcgcggcgaggcgcgggccgtattcggccgcgcgggtcgaccagtgttcgcgatgaacgatggcggcctcgaccgcacattgcaccgcccagccggtcagcgctggctcgatcggcggcagggtgacgtcgacgatgcgcgcgccgagcccggtcatcacctcgatcacatgctccatcgaggccagaacctgatcatctgcccgcgccttcaacagcccacggtcgatgccgatggtcaggccccgcaccggtttggtgagttctgccatatagtcaggtacgggaagttgtgatgcggtggggtcgcgcgggtcggggccggccatcacgccgagcagggtgacggcatcggcgacactgcgcgtcatcggccccatatgatcgagcgagggggcgagggcgagcgcgcccgcccggctgacccgcccccatgtcggcttgatgcccgtcacgccgcagcatgaggagggcaggcggatcgagccaccggtatcggtgccgagcgcgccccagatcagcccggcggccaccgccacacccgacccgctggacgaggtgccggtccaatgcccggccccccaggggttgaccggcggcacgacatccgggtggtgatcggcataggcgccctcggtgagggtggtcttgcccagaatgatcgcaccggcggcccgcagccgcgcgatgacggtggcatcctgcgcgggccgccggccgcgcagcaccgggctgccgaattccgtcggcatgtcggccgtgtcgaacaagtccttggccgccagcggcacgccgtgcagggggccgcgcaccagaccggcggcgatttccgcctcggcccggcgcgcctgatccagcgccgcatcgttcagatgggcgaaggcatgaagcgcgccgtcatgggcggcgatccggtccatcatgcagcggaccgcgtccaccggcgacaccgccccacggcggatctcgtctgccaggcggaccaggctcaatctgtgcagggtcgacgacattccggacggctcctctcatcgggctgcgggcgcgggcatgtcagtattatacaagaatgcctgtttcgtgttcaaaaatcgtcgatgctcataaaacaggcggttcgtcccagggcagatgccggagaatcgcgggatggcgagatggaaggcggtggcatgcatattgcgtgggcgcgcctgcacaccggatgaccgggccgtgcgcagaacccccgccttgcccacaaaaaaatgctccggaaggcttcgatccatgtatatgcgcattgcgaaacggggggcggtcgcccttggtctggccgcggcagccgtctttggccccatgggtggggcggcgaccgccgatgcggcagaggcggtgtcggtgcggctgaaatggctgccccaggcccagttcgccgggttttacgtcgccaaggccaagggtttctatgaagccgagggcctggatatgaccatcaacccgggcggcccgaacctgaatgccgaggcgctggtggcctcgggcgccgataccttcggcctcggcagcgggacagaggcggtgctgcatgcccgcgccaagggtctgccgctgatctgcatcggcatgtcgcagcagaagacccccttcgccttcgttgcgcgcgagacaagcggcatcaagacgatcgaagatttcaagggcaagaaggtcgcaacctggtttaccggcccgcaatacacgctctattcggtgctggccgcggccaagatcaaacagtcggagctgaccatcatcccgcagccggtctcgatggcgcccttcgtcgcgggtgagttcgacgtcgccaccgtcaccttctacaacgagctgaacacgctgaaagagcaggggatcaccgatctgacggtcttcactcccgatgactatggcgtgaccacccagcaggacagcttcatcacgtccgagaagatcgcgaccgagaagccggagctggtccagggcttcctgaacgctaccctgaaaggttggaaatacgcgtttgagcacaaggcagaggcgatcgacatcgtcatggccgcggcggaggggctggagcgcaagcaccaggaggcgatgctggacgagatcgaacggctgatggttgccggccgcgccgccgatgaaggcctcggcgcgctcgacatggcgtcgatcgagaaggtgcagagcgatctggtcggcttcggcgcgctgaaggagccggtcgacctgaaggccgccttcgacgagagcttctgggacaaggtgccggctgcggacaagatgctctgagcctccacaaccgcccgcggaggagatcctgcgcgggcggtgcttgactcgacggcgtgcgtatacaatagtgacgttattgcattcacaaacgcatgttatgcgtaccaagcgagggttttgagcggtgaagctgggtcttgaaggcaagaaggttctgatcaccggcgcatcgaagggtatcggcctggccgctgcctggagctttgcccgcgagggtgccgatctgcacctggccgcccgctcggaagaggccctggtcgaggcgaaggcggcgatcgaggcggaatgcggcgtggcggtgacgatctaccccatggatctgtcgagcgatgcgcagatggtggcgctggccgatgccgcgggtgatgtcgacattctggtcaacaatgccggcaacatcccctcgggcccgatcgatgcggtggatgatgtctcctggcgccgcggtttcgacctgaaggtcttcggctatatctcgctgacccgcgcggtgtatgcccgcatgcaggcgcgcggcaccggcgtgatcgtcaacgatatcggcaattccggcgagaactgggatgccaattacatcgccggatcgaccggcaatgcggcgctgatggccttcacccgggcactcggcggggtgagcatggattacggcgtgcgggtgctgggcgtgaacccggggccggtggaaaccgaccgcatggtgcggctgatgaagcgacgcgcggtcgacatgttcggcgacgaaacccgctggcgcgagctgttcgaccgctatcccggcggccgcccggccacggccgaagaggtggccgatctgatggtgttcctgtcctcgccgcgcgccggctatgtcagcggcacgatcgtgaccatcgatggcggcatcgcctcgcgcgggtcgatcatcaaggatggcggccggcggtcggtcgcggcgcccgcgcttcaggagcccgccattcaggagatcgatgcgtgagcctgctcgacaccaagaacgcctatttcgaccggctgttttccgaccccgagctgaaatggctgggccagaacaccaatcacgtgccccagcatccggcggttgccgccgccatgcatgcagcggtggatgccgagaatttccatgcctatgccccgcccgccggcatggaggcgctgcgggcggcgatcgtcgccgatctgcggctgcccggcgcccaggcgctggtgaccgacggcgccgtggcggcgctggcgctgatctgccgggcgtttgcgaagcccggcacgaccttcgtcaccaccgatccgggctggaaatggccgctgcaattcgccgcccagaacggcgccgaggtgatcgaaatcccgatctacggccccgaatggaatttccgcctcagccccgaacggctggccgaggtggtggatgagcggaccgcgatcatctatctggtcgacccgaacaacccgctgggcatcacctataccgccgaggaaatcggcgccttcgcggcgatcgcgcgcgaggcaggcgcgatcctgatccatgacagcacctatcgcgacttcgccgaaggccatacgccggccagcatgatctatcccgaaggcgcggtgacggtggtcagcttctccaaatggctgggactggcgggcatgcgcgtgggtgcgctggtcgcataccccgagctgatggacaggattgcaccgttttcgaccgcgcccttgggcgccagcgtgatcgcccaggcggcggcgctggccgggcttggggtcaaggacgaatggatggccggggtgcagcagatccagcgccacaaccaggcgctgatcaaacaggcggtcgatgccctgccgggcttcgccatgccggtctacccctcccacggcaatttcgtggtggtggaatgcatcgaggccggggtgcggccggaagcgctggtggccgagtttcagaccgcggggatcatgatccgccagggcacctatcatacgccccgcttcggcgaccgcttcatcaaggtgtcgaccaccgtgccgaccgcctgggtcgaagccttctgcgccctgctgcccgagatggcggaacgggcgaagacccgcaccgacatcccgccgctgttctgaccggaagggcaagtccgatgtcttttgccaccgcaaccgacggcacccgcctctattatgaagaggcggggaccggcacgccgatcctgttcatccatgaattcggcggcgattatcgggcctgggaaccgcagatgcagttcttcgcgcgccggcatcgctgcatcacctattccgcccgcggctatgcgccttcggatattccggcggatgtggcggcctattcgcaggagattgccgtcaccgatgcgctggccgtgctcgaccatctgggcattgaccgcgcgcatatcgtcggcctgtcgatgggcgggttcgcgaccctgcatttcggcctgatggcccccgaacgcgccctgtcgctgaccatcgccggggccggctatggcgcggaaaagcagttcgaggactatttccgcggggtttccctggaagtggccgagcggttccggacgctgggggccaaagaattcgccaagacctatgcgctgggcgccagccgggtgcagttccagaacaaggatccgcgcggctggcaggatttcgccgaccgcctggccgagcattccgatatcggcgccgccaatacgatgagcggcgttcaggcgcggcggccgtcgatctacgatctggaagagcggatccgcgcctgcaccgtgccggcgctgatcgtggtcggcgacgaggacgatcattgcctgcagccgggcatcttcatgaagaagaccctgccggccgccgggctggcggtgctgcccaaaaccggccatacgctgaacctggaagagccggcgctgttcaaccagctgctggccgagttcatcgccatggtcgaggccggacgctggacggcccgcgacccgcgcgccgagccggcgcagatcatgaagacgtcgtgatccttatgtccggcgatggtggcgggacaggcggcgcggcgccggcggagagctggcgccgccgcaccgactggcgcaaggaaacgggggaggggtatatgccgagcggtcgcgagatcacgccggaggccgaacgcattctggggcatgtaaatggcgaccggttgtggcagcggcatatggaactggcccgcttcggcgcccgcagcgatggcggggtcgaccgccaggcgctgtcggccgaagagatcgaggcccgcgcccatctgatcggcatcgcccgcgcccgcggtttcggcgttgcaaccgatccggctggaaacctgttctttcggttgcaggggcgggagccgcatctgccgccggtgctgtcgggatcgcatatggacagccagccgaccggtggccgtttcgatgggatctatggcgtgctggccgccttcgaggtgctggaagcgatccgcgatgcgggacacacgccccgccgcagcatcgaggcggtggcctggatgaacgaggaaggctcgcgcttcgccccgggcatgatgggatcggaagccttcgcgggcgtgcggccgctggacgagattctgggcgtccgcgatgccgacggggtgagcgtcgccacggcgctggccgccgtgaactcagccttccccgatgtgccgctgcgcgagctgggccagccgatcgaggcctatgtcgaggcccatatcgaacagggcccggtgctggaggccgagggccgggtggtcggcgccgtgaccggcattcagggcaagcagacctatcgcgtgacggtgaccggcgaagaggcccatgccggcacaaagccgatggccgagcggcgcgatgcgctgatcgccgccagtgccatggtgcagcgccttcatgccatcgcgcgcagcacggccgaagatctgatgctgaccttcggccgcttcaccgtttcgcccaacgcaccctcggtggtgccggcgaaggtggtgttctcgatcgacctgcgccatttcgacaccgggctgatgcagggcttcggcgcggcgatccccgatctctgcgccgagctggccggcggttgcggggttgtggtcgaacctctggtcgacgcgccctcgctggtgtttcccgaagcgctgcgcgaccggatccgcgacatcgccgcggtgctgggccatccggtcatggacctggcctcggcggccgggcacgatgcaaggcacctgcacgccatcgcacccacggcgatgatcttcattccctgccaccagggcatcagccaccacccgaccgagcgggctgaacccgaacacctccatgccggcacccgggttctggcggcgctgctgaccgagcttgcggggtagggtggcgggagatcctcagttggcgggggatcctcaggcgcaggcgggatccgcggccggtgccgccgcggcgcgccggtccagcgcgccgctccagagggtgagggcgagggccgccagggtgatcagcgccccgacccagggcgtggcgctgagccccaggcccgaggccaccacccggccgccgatccaggcacccgcggcgatgcccaggttgaatgcggcgatgttcagggccgaggcgacatctactccttcaggtcggtgaagcctggcaagcttcaccacgtagagttgcaggcctggcacattggcgaattgcagaaagcccagcgccgccagcgtgaccagcgccggcaccgcagacagcagcgtgacgctgaaggcgaacagaaccgcggcctgggcggcgaagagccaggcgagcgccctgaccgggttgcggtcggccagccggccgccggcgatgttgccgatggcgatcgcgacgccatagagcaccagcaccaggctgactgcggcattcggcaggccggtcacctgttccaggatgggcgccaggaaggtgaaggtgacgaaggtgccgccatagccggccgccgtcatcccgaagaccagtagcagccggcccgagcccagcacgcgcgcctgatcgaccagccgggccggggcggcgcggggcagatcgcgcggcagcagggcggcgatgccggccagcgcgaccgcaccgatcagcgccacggcctggaaggtggcgcgccagccgaaatgctgcccgatccaggtgccgagcggcacgccggtgacgatcgccaccgtcagcccggcaaacatcatcgcaatcgccgaggctcgccggttttccggcaccagatcggcggcaatggtggcgccgactgaaaagaacaccccgtgggcgaaggccgacagcacgcgggcgaccagaagcacctcgtagcccggcgccagcgccgccagcccgttgccggcgatgaacagcgccatcagccctaacatcaaaggcttgcgcgccgcgcggccggtgagcgcggtcaaaaccggcgcgccgaaggtgacgcccagggcatagacactgacgatcaaccccgccgcaggcaggtcgatccccagatcctgtgccaccgtcggcaacaacccgacgatgacgaattcagtggttccgatcgcataagctgcgatggtcagggcaaacaaggcgggaggcatggcggacactccaaaccgcggaaccagtctcgcccggcactatgcccctgtccctcaacatcgataatccgccatggatgacgatcactctgtcatatgatgacagaataacccccgccgaccggcccctgcgcgaaccgcaggtacacgtaaaaaccccgggaggttcgcggtgaagtttttccttcatcatcagggcattaccaattctcaatggcgcatcactcatacctgaccaggatctccccggagattcgcgcaaaccgcattttttccggccgtgattcggggtattaaaggggggtgggtcgcaccatcagacccaaccgattgtctctgaaagaaaatcccgtcatcccggcgtgagggctgacaattgcctttcgccggaatgacgtataaatgcttgacggatgccggtcagtacgggatccgacatgaatgccgggtgacgggggctctcctcagaggcccgaccagcgccaccccaaccaccagggaggcaccaccatgcgcgcccgacgccggcatgatgccgaacgccgcaaggcgaaagcccggcggatcatggccttgtggtttcccgatcaggagccgcaagggttttccgcgcgtgcagtgggacgcaatgcggcgacgcattgccggccctgttcctgtgtgctctgccgggggccgcggagtggggaggagcggccgcgccggcgggtggtgatgaccgacgaggtctgagtcaaggtgtaagcgggggcgtacggatttggatgcccaaaaaaataaggacacttggggtcgccgaatctcagtggtaacgtgacagaccactcggaagtatctggctcagggacttattctgttctgacgtggcggattaattaacaaatcggaatagataaatgcggaaatacgccgtgctgactttgggaaccttgattgttgcgccgattgttgcgccggcggcggatagaatgcctatggaacgggaagatgcagcaataattatatctgcgattgatagcttagccagtattgtagcccagggtaatgcgatgtcttctgccgccggcgtatcagctgcagctgccggaggaatttctgaagcgatgaaagaaaagtcgaataccaagaaggcgggagatctattgttggtgctctctgagcagataaatgaagcacttctaaaatattctatgaatattaattctgaagcatcagatagaataattgaagcaagaaaaattgttatttcaattgaagaacatcaaagagtaccaacggaatcagaatgtaaatcaatacttgtgccaattggcgagatggcaaagaacgcggacgccggcggcagcctgagcaccacacttaaggcagctagtcaggcttcaggatacttcggtgatataatcactatggaggatggtgaggatatcgccgtgcattttcggacgcttacgcgagatttggcagaagtaaccgcgcgatacgccgcagtgtcgtcgcctgatgcgcggcagttaatcatggcgtcggggcctgttcttgggcgaatctgccggatgggcctttagttcactgagaaaacaggtccgcgcaagttgcgtccttccggacgcgtggctgatacgctcggcccgcacgtttgagcgggtatacttatgtgcacccgcacctgagaatctcgccagccagcgactaactggccgctgccggttcatccgtcggcaggcgagcgatcccgacgccgcagcgcccggtcaccctggtgccccgtcatccgggcgggttcatcggatccaggggcacgatttcggcccagatcttgttgcagccctcggcccgccagatcgatcggaccatgactctggcgccggtgtcgtaccatccgaggaccggcgggcggttggtcgatacgcagctgccagccaggttgctgccgtaatcgtaatggccctgccggatgttgactggcgaggtcacgcgccagtcgcggccggccagccggtcgggcgcgaatgacccggcaccgtaaaggccgggcgcttcccatcggccatcggcatagctgtccaggaacatccaggcggtgccgtcggcggatgtcgttgtggccggcggtggggcggctgccgctgccggctgcggcgccgcgctctctcctgagggcgcgtcgcgcagggccgtgtcggccttgcagaacggctggatcagctcaaaacaatgggtctcggtataacgtcgatggcgagaatgatgatgccggtcagtatggccaccagaaacgccctcatcgccacctccaatggctgcgcgttccagatcgtctgatgaccggcgcggcttgtcaatcgggggtagatgagtctgtcagtctgttgcggcgggcacccgaaacggcagcggtgccgcgcccggtgcgccatccggtttcagcccgttgaacacgatgtcgatgaaactgtcggcataggaggtggcggcctcgggatcggtcagcggcgtgccgtacatccgttcgatcatgccggaaaaggtgaagatcagcgaggcgccgaagacgatgatcagggtcacgtcgcgcaacggcatctggcggatggcgccggccgccatggcctcgcggatcgcgccttcgaacttgtcgaaggcggttttcatatagctttccaccagccagtgcatgcggtcgcccgataccgagccttcatgcaccgtcacccgggcgaaatcggggttgtgggcgttggcatagaccaggcccttggtcagcagtttcagtcgggtcagcgggtccatgccgccgggtttttcggcgagggtgtcatagaaggcgatgcgttcggccatcagccggtcgatcgccgcctcccagatcttctgtttcgagccgaaatgataatgcacgatcgactgcgtcacccccgcctcggccgcgatcgcgccggtggtcaccggctcgtagccgaggcgcgcaaacagcttcgtggcggcatcgagcagggcgttgcgggtggcatccggcccggcatcgcccagcggcggccgcccctgacggcggcggcgcggcgtggcggtactcgtctttcgggtgcgcacgggctttgataccgattttgggttgtcgttctcctggcgcgccatcaccctcataccatgtttcaaccggcgttcagcgcctggaccatagccccgtccggcgcgccggcccagcccgaaatcaccgggccggaccgggacgccggtccggtcacggcttcagcagcgggcagtcgctttccgccgccgggcggtaggcctcggcaccggggatggtggtcttctgggccagatagtcgagcggatatgtcgactccgccgggctcttgacctcgaagtaatacatgtcgcgcatcagccgcccgtcggcgcggatggtggcgccgtcggtcatgaagtcgttgaccggcatggctttcatcttcgccagcactgcctgggtcccggtggtgcctgcggcctccaccgccttcagataatgcaggaccgagctgtagacggtcgcctgcacatccgtcggcaccttgccgtggcgggccttgaagcgttcggcgaaggcgcgggtgccgtcggtctggtcccaatagaaatccgccaccaccggcatgcccttggttgcctccagccccagaccctggatgtcgttgacggtgaagaacaaaggcgcgatccgctggccggcctgggcgatgccgaattcatccgcctgcttgatcatgttgcggacatccgcgccgcccgccaccagcgccaccacatcggcgcccgaagcctgcgcctgcagcaggaaagagctgaaatcggtggtgccgagcgggaagcgcacggtgcccttcacgctgccgcccatcttctcgatcacgctgatcgtgtcgccctcaagcccatggccggacgcgtagtcgacggtgaggaagaaccaggaactgccggggttgctcttgaagatgccctcgacattgcccttggccagggcatagccgtcatagccccagatcaggccgttggtggtgcagcggtcgccggtcaggctcttgttgttggcgcccgagaacaccgcgatcttatcgcgcttcatgatcacgtcctgaagcgccagcgagatgccggaattcgacacgtcgaacagcgcctgcacgccctcgtcgtcgaaccatttcagcgccgcggtgacgccgatatcggccttgttctgatgatcggccgacaccagcccgaccggctggcccagcaccttgccgccggcatcctcgatcgcgagttcggccgcgaccaccgatccctggccgccgaaatccgaatagaccgaggacatgtcggtcagcacgccgatcttgacggcatccgccgcctgcagctcggccatctggcacaacaccgccagtgccgccgcgagccccgcggcgggtttcattatcctgcgcatgtgatctttcctcccgatcccggtcttggcgccggggcgtggtcgtgtgtgtggggagggccggcgtgcccgtctttgcgggcatcgccggccgggagtcttgcggctcagcgcgtggcgatgaagggccgccgcttgccgcctgccgccggtgccggcggcaccgggaagccgtcgaggccgcgccgcacccagtcgcggctggcggcggggtcgatcacgccgtcgatttcaaggaaggccgccatgttcgacgccttgcccttggcataaagcgcatcgaccagcttgcggtagagcgcatcgcgcccggccgggtcggcgatggcttcaagatcgcggcgatagcccaggcgtacggccccttccaggcccatgccgccgaactcgccggtcggccacgagacggtgaaggcgggggcgtgcatgttgccgccggccatcgcctgggcgcccaggccatagcccttgcgcagcacgatggtgaacatcggcacggtcatgttggcgccgcccacgaacatccgcgacacccgcctgaccagcgcggtcttctcggcatccgggccgaccatgaagcccggcgtgtcgcagagcgacagcaccggcaggccgtgcgcctcgcagagatccaggaagcgcgcggccttctcggccgcctcgccgtcgatcgcgccgcccagatggcggggattgttggcgaacaggcccatcggccggccctcgatccggatcagggcggtgatgatgccgatgccgtaatcgggccggagttcgagcaccgaatccgtgtccgcgaccagctcgatcaccttgcgcacgtcataggcgcgcagccggttttcggggatggcattgcgcagcaaccgctgatcggccgccgcccagtcggccaccggcccctggaaataggacaggtacttcttcgcggcggcgaccgcctcggcctcgtcctcgaccaggatgtcgaccacgccgttcggcacctgaacatccatcggcccgacctcttcgggcttgtagacgccaagtccgccgccttcgatcatggccgggccgcccatgccgagattggcgttgcgggtggcgatgatcacgtcgcagacgcctgcgatcgccgcattgccggcaaagcagcggcccgagaccacggccaccgtcggggctttgccgctcatctgcgccagcagcttgaaggtcggcacgtccagccctgccacgccgacatggtcggtatcgcccggccggccgccgccgccctcggcaaacaccaccagcggcatcgcccagtcattggccagatggaacatgcggtccatcttcttgtggttcatgaagccctgggtgccggccagcacggtgtagtcgtaagagagcagcatgcagcgcgcccgctcggccccgaacagaccggcattcaccgagcccacacccgccaccagcccgtcggcggggctcatcttcttcagcgtctcgtaatcatggcggctgcgctgggcggcgagcgccagcgcgccgtattccatgaagctgccgggatcggccagatcctcgatattctcgcgcgcggtgcgctggccggtcttacgccgccgcgccaccgcatcgggccggcgggcatcggtcaactcgtcatgcagttccaggatcgcggccagatcggggcggatatggtccagatcgacctcgaccgtctcctcttccgcagcgccctcgaagtcacccggctcgatgaacagcaccggctggtcgccatagacggtctcgtccaccgccacggccagcgcccgcacgatgccggcccggcccgcggtgatggtgtgctccatcttcatcgcctcgatgaccgccaccaccgtgccggggcggacgacatcgccgggcgtcacctcgatcgcgaccacccggccggtcatcggggcggccaccgcctcggtgccgtcgggtgcgaccggcccgctcgccgctttcatggccccgccgccgctgctttccacccagagcttcggatggctgtcggcggcctccgccagccgggcggcatgggcgccgatatagccggtatcgaagcgcccggcgcgcaccgcctcgtcggcgatcaggctttgcaggaaaccgatattggtcgccacgccttcgatgcggaattcggccagcgcccggcgggcacggtccagcgccagatccagccggttgcccggcacatgcacgatcagcttggccagcagcgagtcgtaatggggcgaggtcgcatagcccgcatagccgaaggtctcgacccgcacaccgcggccacccggcacctcgaaggccgaaatcaccccgcccgcgggcacggccacggcatcggcgccgatcttctccatattgatccgcagctgcaccgccacaccctcgggctcgggcaggcggccgtcgcgcaggcccagctcggccaggctcaacccggcggccagcccgatctgggtctggaccagatcgacgccggtcacctcttcggtgacggtgtgttccacctgcagccgcggattggcctccatgaacacgaagcgctgcccggccgggtcgcggccgtcgatcaggaattcgaaagtgcacagcgtgtggatgcctccggccctggccagcgccaccgcggtctcggcgatccgcgccttcagcgccgggtcgagcccgggcagcggcgcgatctccaccagtttctgatgccggcgctgcaggctgcattcgcgttcatgcagatggatcacccgcccgtcccgatcgcccagcacctggatttccagatgccgcgccggctggatcagctcttccacataaagcgcatccgagccgaaggcgcccagcgcctcggcacccgcccgggtccaggcttcggccagttccgatgccgcgcgcaccacccgcatgccgcgcccgccgccgccggccacggccttgatcatgatcgcgccgccggcacccaggctgtcgaagaaactccgggcttcatccagcgaggtggcatgggccgtgccgcgggccagcggcgcgccggtctccgccgccagccgccgtgccgcacccttgtcgccgaacaggtcgagcgcttcgggcttcgggccgatgaaggtcagccccgcttcggcgcaggcgcgcgcgaagccggcattctcggccaggaagccatagcccggatggatggcgtcggcgccggtttccagcgctgcgcggatcaccgcggcgccgtccagataggcggcggcgccaacgcccggcagctccaccgcctggtcggcgcgtcgcgtgtgcagcgagcgggcatcgtccctgggcgcgaccgcgacggtcggaatgcccagttcggcggcggcgcgcgcgatccggatcgcgatctcgccgcgattggcgatcaggatacggcggaagaggggagacgaaggagaagagggggaggagggggacgtcatctgtcagctgtgcccgatcttgtcgcgtttcaccacgatgccggcggcctcgcggtcccatgtgtctgccgtgacgcccgccttgcggatcaggtacttttcgaccttgttcgtgggcgtcttgggcaggtccgcaagcatacggacataacgggggatcatgaagtgcgccatgcgcgggcgcagatgctcgatcagcgccgccggatccaggctggcgccctcggccagcgacaccgcaaccaggatctcgtcctcgctgtcggcggcgggcacggcgaccacggccgcttcgcgcacggccggatggccgcagatttcggcctcgacctcgaaggatgagacgttctcgccgcggcggcggatcgaatccttgaagcggtcgacgaagaaccagttgccctgatcatccacccggaaggcatcgccggtgtggaaccagccattgcgccaggcggcggcggtcgcctccggattgcccgaatagccgtggttcatctgccagggcaggtcggtgcggatcaccagctcacccacttcgcccggctcgaccgcccggtcatgggcatcgaccagccgcacctccaccccgtcgcggggccggccgcagctggccaccacctcggggttttcctcggcgatcagcgggcaggagacctcgctcatattgaacagggtatgcagcgtcacgccgaagcgcctgcggaaggcgatggcctcttcggtcagcgggatggcgatgacatgcgcgagggggctgtcttctgccgcgccctcgtcccggtccttcagcaggaaggccgccatcacccccaacaggatgacgcaggtggtgccgctctgccggaccgccggccagaagctcctggtgtcgaagccctcgaccagggcgatggagccgccgagtgccagcatggcatagaccggcgccgtgccgccgacatggaacagcggcagattgaccatgaaccggtcgccggcgcccaggaacggcacccgccgcggatccgacgccagcgccgtgcccatggcgtgcagatgggcgtagctcgacagcacacccttggacgggccggtggtacccgaagtgtagatgatcgactgggtgtcccagggttccaccggctcggcgagcggggcgggggcggtggtgctttccagcgcatcgccacccagccaggtgatcccgtctgcggcgggcagccgcgccgcggccgtggctgcgtctgccgtatcggccacgaccacccggtcgacggcgctggtgtcgatcccgaccagacgatccgccagtgccgcgatggtgatcaccagccgcgcctccgacacctggatcacatgctccagaatgccgcccttataggcggtgttgatcggcacatagatcgcgccagcatagttgatcgcgaaccaggcggtgagacacaagccgccattgggcagccagaccaccacccggtcgtggggcttcacgccgagcgcctgaagggctgcggccatggcgcgcacccggtcgcgcatttccgcgtagctccagacctggctgtcggccccgccccggcgatcgggaaaggcgacgaaggcggcatcgggcgtgtccgcggcgcggcgatccaacagatcgggcagcacgcagtctgcgcggccctgaaggcgcgtgtggtccggcatgtttcctcccatgcggcagctcttgaacggtgccgtcgggatgatggtgcataaatcaatagatctattcaataactgaatcgacagccgtgccgctttggtgcccgcggccgtcggtcagggggatgatcccgcattgcgcgctgaaatcgttttcagaatcaaccgcttcccgtggcgcaaccggggccatgcgaaatttgcgaaaccgtcgctgacatgtctgggttagagtgccccacggcggttcctccccccttggatcacgcctgacgatgcgtgacgacaacgaggtccggccgccatgccccagatccatccgcttccccgacggcgcagcctggcccggctgctgttccgcgtcgatctgcagcggatgatcgtcgccctggcggtggcggcggcaggggtgctgctggccaacggcttctattccagttatctggtccagcgccaggtgttgatcgacaccacgctgaaggccaaccacgcctacgccgccaagctggccgaagccgcgcagaatttcatcgaagaggcccagcagcagctggcctacagcgcggggatcgtcgcccgcgatttcgacaatgaaaacctgctgctcgacgaggccgaacgtctgcggctgcagacccacagcttcaactcggtcgccatcgtcgatgccggggcgatcgtgcgcgccacctcgcccgaggcgctgcagatcaaggggcgctatctgcgctcgctggcggcgcgcgaggcgctggaccagcgccggccactggtcagccagccttatatggcgatcaccggcaatatgctggtggtgatttcgcagccggtcttcacggcagacggccgctatctgggctatatcggcggcacgatctatctgcgcgaacgcaacatcctgaacgtgcttctgggcacgcatcactatgacgacggttcgtatctgtatgtcgccgaccaggggcgcgcgctgctttatcacccggatccggcgcggatcggtgaagtggtgtccggcaacccggtgatcgaagccgcgatcaccggcgtcagcggcagcggcgaagtggtcaacagccgcggtgtcgccatgctggcgggctatgccccggtgccggccaccggctggggggtggtggcgcagcggccgcttgcggtaacgctggcgccgctcgaagggctgatgtggcgggtggcggccaacagcgcgccggcagcggtcgtcaccctggtcgcgatctggtggttcgcccgggcgatttcccggcctctgggccagctggccgaaggcgcccgccagatggacgcccccggcaccgccgaccggatccagcgggtgcggtcgtggtatgtggaggcgcggcagatcaagcgggcgatgctgatcggcatcggcctgcttcaggcgcgcatcggccggctggaccgcgatgcccgcaccgaccccttgaccgggctgatcaaccgccgcggcatggatgatgtcctggagctgtggcgggccgaggcccggccctttgctgcgatcgcggtcgatatcgaccatttcaagcaggtcaacgacagctgggggcacgaggtcggcgatgcggtgctgcgccgggtgggcctgatcctgcggcagaccgcgcgcgacaccgatctcgtctgtcgcaccggcggcgaggaattcctgctgctgctgccgggcctgtcatccgcggcggcggtcgccgtggccgagcgtctgcgcaaggcggtggcgcgggaacggatcgatccggcgggccatgtgacggtctcggccggtgtggccgtgttgcccgaagacgcgaccgatatcggcgccgccctgcgccttgccgacgaaatgctctacgaggccaagcgcgccggccgcaaccgggtggtggcggccggcagcccgcggctgcacggctgagcatccgtcgcgtcgaccctggccgatctcgtcaccgagaggggccccgcgtgacgcctccggccagtccgcgaaatttttttacgcgcgcggccgcatgtcgccttccggggccgggattccgaccccgttcaattcatgacgaaatttttgcggccaagatgtcattcggtaattttatgaccctgcggcgcacggaaccgttttaggtgcagtgcaactcgcgccgcgggtaccggaaccggtggagtgaatgtcttcagggttgcaggcgccggcaggccgccgccactcacggtgtaaagagtggggatgacagcccggatgtttcgctgtcatagtttggccactcggagcgccccatcttcgtctgggatgccatcctcgtctgggaagatcgacgctgatgtccacatccgaacaccttagtctgcatgtacccgagccggcggtccggccgggcgacacccccgacttctcgaccgtcaagattcccaaagccggggccgtgcccagacccgaggtcgatgccgatccggagcagatgcgcgacctcgccttctcgatcatccgcgtgctgaaccgcaatggcgaagccgtcggcccctgggccggcgcgcttaccgatgacgagctgctcgacgggctgcgccacatgatgacgctgcgcgccttcgatgcgcgcatgctcatcgcccagcgccagggcaagacctcgttctatatgcagcatctgggcgaggaggcggtcagctgcgccttccgcaaggcgctggtcgacggcgacatgaacttccctacctatcgtcaagcggggctgctgatcgccggcggctattcgatggtcgacatgatgtgtcagatctattcgaatgcccgcgacccgctgaagggccggcagctgccggtgatgtattcctcgcgcgagcacggtttcttcaccatctcgggcaacctcgccacccagttcgtgcaggcggtgggctgggcgatggcctcggccatccgcaacgacaccaagatcgccgcggcctggatcggcgacggctccaccgccgagagcgatttccacgccgccctggtcttcgcctccacctacaaggcgccggtggtgctgaacgtggtcaacaatcagtgggccatttctaccttccagggcatcgcccgcggcggatcgggcactttcgccgcgcgcggtctgggcttcggcatcccgtcgctgcgtgtcgacggcaacgactatctggcggtccacgccgtcgccaaatgggcggcggagcgggcgcggcgcaatctgggcccgacgctgatcgaatacgtcacctatcgtgtcggcgcgcattccacgtccgacgacccttcggcctatcgtcccaaggctgaaagcaccgcctggccgctgggcgatccggtgatccggctcaagaaccatctgatcacccgcggcgtctggtcggaagaccgccacaagcagaccgaggccgaaatcctggacacggtgatcgccgcccagaaggaagccgaaagccacggcacgctgcacgcgggcgccaagccttcggcccgcgacatgttcgacggcgtcttcgccgagatgccggcccatctgcgccggcagcgccagcaggcgggagtctgaacccatgccacgcatgacgatgatcgaggccatccgcgacgcgctcgacgtgatgatgggccgcgacgaccgggtggtggtctatggcgaggatgtcggctatttcggcggcgtcttccgctgcacccagggcctgcagcagaaatacggccggacccgctgcttcgacgcgccgatcagcgaaagcggcatcgtcggcacggcgatcggcatggccgcctatggcctgcgcccctgtgtcgagatccagttcgccgactacatgtacccggcctatgaccagatcacccaggaagcggcgcgcatccgctatcgctccaatggtgatttcacctgcccgctggtgatccgcatgcccaccggcggcggcattttcggcggccagacccacagccagagcgtggaagccctcttcacccatgtctgcgggttgaaggtggtggtgccgtgcagcccgcacgacgccaagggcctgctgatctcggccctggaagatcccgatccggtgatcttccttgagccgaagcggctctataacggccccttcgacggccatcacgaccggccggtgaccccctggtcgaagcacgaggcgggcgaggtgccggccggccattactccgtgccgctcggcaaggccaatatcgtccgccccggctccgccgtcaccgtgctcgcctacggcaccatggtctatgtcgcgcaggcggccgcggccgatgccggcatcgatgccgaaatcatcgatctgcgcacgctggtgccgctcgacctcgacaccatcaccgcctcggtgcgcaagaacgggcgctgcctggtggtgcacgaggccacgctgacctcgggctatggcgcggaactcaccgccctggtgcaggagaactgcttccatcatctggaggcgccggtcacccgcatcgccggctgggacacgccctatccgcatgcccaggaatgggactatttccccggccccgcgcgtgtcggccgtgcccttcaagagatcctggagagctgacccatgggcgagcatatcatcaagatgcccgatgtcggcgaaggcatcgccgaggccgagctggtcgaatggcatatcgaggtcggccagatcgtccgtgaggacgcggtcctggccgcggtgatgaccgacaaggcgaccgtcgaaatcccctcgccggccgatggcaaggtgctgtggctgggcgccgaaatcggcgacgtggtcagcgtcggcgcgcccctgatccggctggaggtggaaggcgagggcaatgtcgccgccggtgcggcagcgcccgccgctgctgcgtcgaagcccgccgcggcccagcctgcggacgaggatgacggcgccccgccggccgccccggcccaggcggcggagccggcgccggaactgaagaccgtgcccaagccgcagccggctgcgaagcccccgattaccagttccggcgcgggtgccggcacggtcgccatggccccgggcgccccccggggggagcatgaaaagccgatcgcctctcccgccgtgcgccaccgggcgcgcgaggccggggtggatctgcgccaggtgcgcggcaccggtccggccggccgcatcacccatgaagacctcgatcgcttcttcgccggcaaggaccagcgccccgccgccggcgggctggtggccgataccagcgtcagcgaaatcaaggtggtcggcctgcgccggcgcatcgccgagcagatggcgctgtcgaagtcgcgcatcccccacatcacctatgtggaggaggtggacgtcacggcactcgaagagctgcgcggcaagctgaacgccgaaaagcggaccgaccggcccaagctcaccatcctgcccttcctgatgcgggcgatggtgaaggcgatcgccgaacagccgcggctgaattcgcgctatgacgaccaggcgggtgtcatccaccagcatggcggcgtgcatatcggcgtcgcggcccagacccccacgggcctggtcgtgccggtggtgaagcataccgaggcccgcgatctctgggcctgcgccgcggaactctcgcgcctggccgaggcggccaagaacggcaccgcgacgcgcgaagagctgaccggctccaccatcaccatcacctcgctcggcgcgctgggcggcgtggtcaccaccccggtgatcaaccatccggaagtcgcgatcgtgggcgtcaacaagatgatggtccgcccggtctgggacgggtcggccttcgtgccgcggaagatgatgaacctgtcgtccagtttcgatcatcgcgtgatcgacggctgggatgccgccgttttcgtccagcgcatcaagtcgctgctggaaaccccggcgaccatcttcatcgagggctgagacgatgaaggatatttcctgcaagctgctggtgatcggcgccggcccgggcggttatgtctgcgcgatccgtgccggccagctgggcgtcgacaccgtgatcgtcgaggcgaaaaagccgggcggcacctgcctgaatgtcggctgcatcccctccaaggcgctgatccacgcggccgaggagttcgagaagctggtgcatatggccgagggccaatcgccgctcggcatcaccgccacggcgccgaagatcgatctggcccgcaccgtcgcctggaaggaccagatcgtcggccggctgaccggcggcgtgtcgggcctgctcaagaaggcgcgggtcaaggtggttcagggccatgcccgtttccgcgacggcaagacggtcgaggtcgaaaccgaaaccgggcttcaggtgatcagggccgaagcggtggtcatcgccacgggctccgagccggtcgagctgcccttcctgcccttcggcgaccgggtgatctcgtcgaccgaggcgctggcgctcacctcggtgccggagcgcttcgtggtggtcggcgccggctatatcggcctcgaactcggcaccgcctatgcgaagctgggcgcgaaggtgacggtggtcgaaagccagtcgcgcatcctgccgctctatgatgccgagctgacccggcctgccgcgaagcggctggaagagctgggcgtagaggtgctgaccggtgcgaaggcgcgcggcctgtcgcgcggcggcgacgggctggtggtcgaaacccaaaacggggacgagatcaccctgccggccgacaagatcctggtcaccgtcggccgccgcccggccacgcgcggctgggggatggaggaactggtgctcgacatgcaggggcccttcatctcggtgggcgagcgctgccagacctcgatgcgcggcatctatgccatcggcgacgtcaccggagagccgatgctggctcatcgcgccatggcccagggcgagatggtcgccgagatcatcgccggccataaccgggtctgggacaagcgctgcatcccggcggtctgcttcaccgaccccgaaatcgtgaccgccggcctctcgcccgacgaggcgaagcggttgggcaccgaggtcaagaccgcccagttcccgttcacggctaatggccgcgcgatgacgaaactgggcgagcagggcttcgtgcgggtggtcttccgcgccgacaacaatctggtgctgggcatccaggccaccggccagggcgtctcggaactctccgccgcctttgcgctcgccatcgaaatgggcgcgcgtctggaagacatcgccggcaccatccacgcccaccccacccagggcgaggccttccaggaggcggcgctcaagggcctgggccacgccctgcatatctgaccgggcatatctgaccgggccacgccctgtatattcggccgggccacgccggcgaccacatcgcggccacgctccccttgggggcgtggccgtcgtcgttccggtctgtgatgggcccctcttgtgaggcatctcaccgggattaatgaaccacggtcataaagccgatcggaaaatcgcccctaatcctctggtgccggcgcgccatcttcttcatctaccggacccgcatccgccgcctggcggcgcaataacctcaaggacatgggcgcgggacggaggtgagacgacaaacaggcggaacggggacaagagccatggccttcgacatcacgatcaacggcgcccgccatcaggtggacgtcgacggcgacacgccgttgctttgggtgctgcgcgacgtgctggggatgaccggcaccaaattcggctgcggtgcagcactctgcggggcctgcacggtgcatatggacggccagccgatccggtcctgcatcacgcccgtggaggcggtgggcgaggcgccgatcaccaccatcgaggcgctggagaccctgccggtcggcccggcgctgcaggcggcctgggtggcgctggacgtgccgcaatgcggctattgccagtcggggcagttgatgtcagccgcggccctgttgacggaaacacccaagccgtccgatgccgagatcgacggcgccatgtcgggcaatgtctgccgctgcggcacctatccccgcatccgtgcggccatccatcgcgccgccggcgcggtctgagcggggagcgcgatccgatgatcaatatcacgacgaccggtatgacccggcgcagcttcctgacggccggtgccgccgtgaccggcggactggtcgtgtcgctgaccctgcctttgggcatccgcccggccgatgccgccgccgcttctgccgatacggcgcgctttgcccccaatgccttcatccgcatcgatcatcagggcatcgccaccctggtgatgccgatggtcgaaatgggccagggcgtctatcagggccaggccatgctgatcgccgaagagctggagatcggcctggatcaggtccggctggaacatgcgccggccggtccggcctataccaacccgctgctcggcggccaggtcaccggcgggtcgaccacgatccgggcgatgtggcagccgctgcgccaggcgggtgccgtggcccgcaccctgctggttcaggccgccgccgcgcgctggggcgtggatcccgccggctgcaccgcgcgcgatggccgggtgcatgatgccgcaggtgggcgcagcttcggctatggcgagctggtcgatgatgccgcccggctgccggtgcccgatgcggcgaccgtgcggctgaaggatcccgccgatttccgcctgatcggccagccgctccaccggctggacacacccgacaaggtgaacggtcgggccgctttcggcatcgatgcccggctgccgggcatgaagatcgccgccatcgccatcgccccggtcttcggcggccgccccgccgggctggacgaggcggcggcgaaggccgtgcgcggcgtgcatcaggtggtgacgaccgacgaggccgtggccgtgatcgccgaccattggtgggcggcccataaggggctggaggcggccgcgatccgctggcaggacggcgagcatggcggcgtcagcatggccgatctgcgcgccgatctggacgccgcctcgcgccgccccggcgccgtggcccgcgacgagggcggggtggatcaggcgctggcaggggcggcgcagcggctggaggcggtttatgaactgcctttcctcgcccatgcggcgctggagccgatgaactgcaccgtgcatgtccatgacggcgcctgcgacatctgggtcggcacccagatccccggcatcgcccaggcggtggcggcgggcattctgggcatcccggccgagaaggtcacgatccacaaccatctgatcggcggcggtttcggccggcggctggaagcggacggcatcgcccatgcggtgaagatcgcccgccaggtttcgggcccggtcaaggtggtgtggagccgggaggaagacatccgccacgatatgtaccggccctattactacgatcggttgcaggccggtctcggtgccgacggccgtccggtggcctggacgcatcgggtctcgggctcgtcgatcatggcccgcttcgcccccgccgccgtcgtcaacggcgtcgaccccgatggtgtcgagggtgcggccgaaccgccctatgccttcccggcgatccgggtggagttccagcgggtcgaaccgcgccatgtgccgaccagctggtggcggggtgtcggccccacccacaacatcttcgtggtcgaaagcttcatcgacgagctggcggcagctgccggcgccgatccggtcgcttatcgccgcagcctgctcgacgccaatccgcgtgcccgcgctgtgctcgaccgtgccgccgaggctgccggctggggcggggcgctaccggccggccatggccgcggcgtcgcgcttcaatacgccttcggcagttatctggcgatggtcgcagaggtgaaggtcgcggccgatggcggggtgcgggtccatcgcctggttgcggcggtggattgcggccgcgcggtcaaccccgatcagatccgcgcccagatggaaggcggcgcgatctttggcctgacggcggcacttcatggcgagatcaccatcaccgatggccgggtggcgcagggcaatttcgacacctacctgccgatgcgcatcgacgaggtgccggtggtcgaaacccatctgatcgacagcagcgaggccccgggcggcatcggcgaaaccgccaccgccgcggtctcccccgccgtcaccaacgccatcttcgccgccaccggcaaacgcctccgccgcctgccgatcgatccggcggcgctgaagcgcgcgtgaggccggcccggcccatctgatccctgatcggcggcggctgccgaagccgccgccgcttctttccatcacaattgactgaccgtcagtcataatatagacaggggaggcaaaccggcggcagctcgccgggcgagagggtcatcagggatggatgccgtatgatgcacatagccgaacctgccacaggccccggagccccggggcgggtggcgatcacgatcgctttcgtcctggtctgcctgaacctccgcatcgttttcggcggggtcgggccgctcctgccctatatgtcgctcgacccgttgactgccggcgcgctcaccgcctttccgccgctatgcatgggcctgttcgcgcccctcggcgccgtggcagggcggcggctgggcgaggcgcgtgccctgttcgcggccatggcgatcctgaccgccgggatcctgatccggtcctgcgggatgaccggcctgctggcgggcaccgtcatcgccagcctgggcgtcgcggcgctgaacgtgctgacgccggtcttcgtgcgccgcaatttcggcggcccccggatcggggtgatgatgggggtctatgccatgatgatgggcgggggtggcggcatcatggccgcgctggcggtcccgatctatcatgccgcgggcgacagctggccgatcgcgctggcaggcgccgcagtgcccgccgccatcgcgctggcgatgctgattcccctgcttggcacgccccgttcgcccgccggttccagtggggcggggcagcgctggcactggctgctgagacaccccaccgcctggagtctggtctgcttcttcggcatccagtgcctcgtcttctatgtggtcctggcctggctgccggcgatctatgtcgacaagggggtgtcccccgccacggccggcctctatctcgccctctgcatcctggcggtggccgctggcggcttcttcgggccgacgctcgccgcgcgccgggatgatcaccgcggtcatatcctcgtctgtatcgcgctctgcatcaccggtctcgccggcgttcttctggcgccagcggaaaccggggtcgtctggtcggtcatcctcgggctcggcatgggggcgggccagggcatccccggcgtcctctatgccaggcggaccgccgaccatctcggcatgatgcagctctcgggcatggtgcagagcttcggctatctgatcgccgccacggggccggtcatggccgcggcgctgcatggctggagcggcggctgggcctggccgatcggtgtcctgctcggcctgctcgtcttcaacgggtttgcggggctgcgcggcggtcgcgatcatgtcatcggcgcggacggcagatgaaacccgccggcggatgggctatcactgcgaaaacgacctgaagggggcggtaaatgaccggggcagccgacaagcggccaagaaccaagccggcggaaatccgtcgcgacgagttgatggatgcggcggagtccctgtttctgaggaaggggtttgccgcgacgagcgtgggggagatcgttgcggaagccgatgtcgccaaaggcaccttctatctgtacttcaagaccaaggacgatgtcctggacgccctccgcaccagatttatcgaggggttctgtgaaaagctggacctggccctggccgccggggatcgggactggtccggtcgcatcgatatctgggtcaggacctgcgtgaacgcctggctcgacagcgtggcgcggcatgatctggtgtttcatcagcacgcgccggccgatcgggccatgaaggccgacaatctcgtgatcctccgcctggcgacgctcctggagcagggggcgcaggcgggggcctggacgatcgatcacccgcgcatggtcgcggtgatgctgttcgacgccctgcacggcgcggttgatgacagtctcgccgcgaagacaccgctgagccgggcgcagctgatcgctctgatcaccaggttctatcgccgggccctcgccatcgatcagggctgacggcggccgggccagaaggcggcggccctgccgcccggtcggtcgccgccgtctcccccctcaggccgccgccgcctccgcctgccagcgggccaccatctcgtccgtcgtggtcacgtcgccgaactgcagggcgaaattggtcagcgcgccgcaatgttcttcggccgtcaggctggcattggcatccgccaccatggtggtgcggtagttcagcatcatcgcatcgcgcgccgtgctgtcgcagcagacattggtcatggtgccggccaccgcgaccgcggtgataccgcgggccttcaatgccgcatccagatccgatgcgccctggatgaaggcgctgtagcgggttttgcccaccaccagatcttccggctgcacatccagctcgggccagaggaaggaggggcgtgcggtttcggccagggcggccgatcgcgcctgcatgcgctccggccgcatcagcacccggtgaaaatgcgggatctcggccagggcctgatcggtgtaaagggtgcggatccacaccaccgttcccccggccgcgcgcagcgccgccgccagccggttgacattgggcacgatcgcgcgggccgccggcacctccgccggcatgcccggctccatgaaccagatctgaaggtccaccaccaccagcgcggtttcgcgcgcgggcaggcgatgatggaccagcggtgccccctggcgggccatgatccgcgccatcgcccaatccggcatcacatattcgtgcatctgattaaaccttgtgcagttttggtccgcaactctgggccggacccggtcttcgggggcaggtaaaatcgtatacagtagacagtaggcgagcaacggcgttctggcccgcggtttgcattcaccgcttcccaggcacatcacatgcctccgcaggcggaggccgggtcaggggaatgggggacggatgatcaaccggatcggagatcggcagaggggcgctgtggcggcggtgctgggcgcgatgctggccacgatggtggcggcgcagccggcagcggccgaagagctgacccgggtcagcttcatggagccgatccactcgctgttctacgcgccgctctatgccgccgacggcaagggcttcttcgcggaagagggcatcaaggtcgatttcgcggtctcgcagggcagcgacaaggcgacggcggcgctgctctcgggctcggccgatgtcgtgctggtggggcctgaaaccgcagtctatatcgcgggcggccgttcgccggtgaagacgaagatcttctcgggcctgacggccaccgacggctcgttcctgatggggcgcgaaggcacggcaggggcggcggccgatggcagcttcgactggtcggcgctcaaaggcgccacgatcatgtcctggcgcaaaggcagtgcgccggcgctgttcatggaggcggcgctgcgcaaggccgggctcgaccccgaaacggacgtcacgctggtcaccaacaccgccattccggccagggtcggcgccttcatggccggcatcgccgattacggcaccttctttgagcccgacgtctcgcggatcgaggccgagggcaaggccaaggcgctcgccaatgtcggcggcgccgtcggccggatcgactacacggtctttgtcgcgaccgaccccttcatcgcgcagcatcccgacatcatccagggctggaccgatgccatcgcccgcggcctcgcctggacggcgagcgccgatccggccgaggtggcgggcgtgctcgcgccctatttcccgggcgtcgaccaggggctgctggccgagagcgtggttcgtcaccgtaccgcgggcatctggaagacgtcgccgctggtcgagccggcggcgatcgacggcctccagaccctgctgaccgaggccggcattctgaagcccgaggcgcgcgtcgcctatgaggacgtggtggcgacccgcttcgccgaggccgcgcccaaggcggtcgccgcgaagtgatccgggcgatgcatcattcatcttggggagacagactatgaccatcggctccgtcctggatcgggcctctccggatctggccaccgtggcggcggaggtgccgccacggatctcgttccgcaatgtcggcctgcgctatttcagcccgcgcggcgagaccgaggcgctgcgggggatcgatctcgacatccgcccgggggaattcgtcgccatcgtcggccagtcgggctgtggcaagagcacgctgctctcgctccttgcagggctcgtgccgccgggcagcggtacggtggcgatcgacggcgtgccggtcaccggccccggccggcgggtggggttcatgctccagcaggacacgctgttcgagtggcgcacgatcctggaaaacaccctgctcgggcctgaacttcagggcggcgacatggcggccgcccggcgccgggccgaggcgctgctcacccgctatggcctgggcgagttcatgcaccacaagcccggccagctgtcgggcggcatgcgccagcgcgcggcgctggcccggaccatgtgtctggagcccgacatcctgctgctcgacgagccgttctcggcgctcgatttccagacccggctgatgctggccgacgagatcgccgacatcatccggcgtgagggcaagaccgcgatcctggtcacccacgacatcccggaagccatctccatggccgaccgggtggtggtgctgagccgccggcccgggcggatccgggccattcacgacatcgccttccccagcgccggcggcacgcgcccgcgggcgatggcggtgcgcgagaccccggaatttccccatcttttcaacctggtctgggaggagcttgaggttcatgcggagtgaggccatgcagagtgacgccgtgaagggcagcccggccgccgcagcggcagccagcgccgaataccgggcttgggcggcggcgcggcggcgggagcggatcgccgtgctcggctggcgggtgctgctggtggtggcggtgctggcgctctgggaagcggccccccgccttggcctggtcaacccgatgctgaccagccatccgagcgcggtctggcagggtttcctggtgctgatcgaggaaggggatctggggctgcatgtcggcgtcacggtgatcgagaccatcgccgccttcgcgctttccatgatcatcggcaccgccgcggcgctggcactctggtcctggccgatggtgcagaaggtgctggatccctttctggtggtcgccaacgccctgcccaagatcgcgctggtgccgatcttctacatctggctgggccccacccagtcgatctatgcggtggccgtcgcggtcgccgtcttcatcaccatcctgatgatgtataccggcttcgtgcagaccgatcccaacaagatcaagctggtccgcacgctgggcgccagccggtcgcagatcctgcgcaaggtggtgctgccggccaatctcgccaccttcatcgccacgctgaaggccaatgcgggcctcgccctggtgggcgtgatcgtgggcgagttccagtccgccaatgccggcctcggctatctgatcgtctatggcagccagatcttccgcatggacatggtcatggccgcgatcgtgatcctggccgtgctgtcgctgctgatctatctggccatccagctggccgaggcccggctgatgcggggcggtgccgggcattgaggggcttgcgtccggcctgccggacaagcccctcgtcttttggtcaaaatcgtatacagtattcaaaattcaaaaacagaaggaggcgttcatgccgttcttcacgcaggactggctgatcgcgggcgcggtgatcgccgtggcggcctgcctgcagggtaccggcgggatcggtttcggcatggtcgcggcaccggtgatggcgatcctgatgcccgaactgctgccggggccgatgctgctgctggggctgatggtcgccgtgctggcggtgacgcgcgagcgggcggcgctggatccgaaggggctgggcttcgcgctggcgggccgtctgcccacctcgatcgccgccgccacgctgatcggcatcctgccggtccgcgacctctcgatcgtctttgcgctggtgatcctgggcggtgtcgcgatcagcgtcaccgtctcgctccgcggccggcgcatcgtgccctcgccgggcaagctgtttgccgccggcctggtctcgggcttcatgggcacgatcacctcggtcggcacgccgccgatcgcgctggtctatcagaatgccgatgcggccgcgctgcgcgccacgatcggcgcctatctggtcgccggcacgctgatctcgatcggcgcgcttgcggccgtcggccgcttcggcctgcatgatctggcgctgggcgcctggctggccctgccgctggcggcagggttctgggtctctgggccgctggcggcccggctgccgcgtaatgccatgcgctggctggtgctggcgctgtcggccgcggccgccgggctgctgctggtgaagcaggtgatctgaaccgccccgctcaccatacgccagtattcggcatcgacgcccagggctcggccttgggcagcggttcgcccttctgcagcagttccaccgagatcagatcgggggagcgcacgaaggccatgtagccgtcgcggggcgggcggttgatggtcacgcccgcctccatcagcctctggcaggtggcatagatgtcgtcgaccgcgaaggccaggtggccgaaattgcgcgcggtgccatagtcttccggatcccagttatatgtcagctcgatcagcggcgcggtctgatcgggaccggtgacgtcgtccggggcggcaaggaagatcagggtgaagcgccccgcctcggagtcccgccgccgcacttccttcagccccagctggtcgcagaagaaggtgagggcggcgtcgaggtcgcggacgcggatcatgctgtgcaggtagcgcacgggaaacggtccttccggcagtcttgaacaggtgaaggcgggtgccaggggtggcgcccgccttcaccatagacccttggccgtccggcgtcagccggccttggcgcgcagccgatcgatgctccagatccctgagcctgccgtcgcgatgaacaggaagacgaaggcgtaaagcgccgccagctcgcccttgttcacgatcggcagcagcccgccattggcatgccccacccaataggccgccgccgccatgccgctgcacagaaaggcggccggggtggtgaacaggccgatcatcaccagcgcgccgccgaccagctcgatcggcccggcgatatagacgatccagtcgggcagggcgtagcccgccggcggcaggccgaacagcttctgggtgccgtgccacaggaacaggaagccggtcacgatgcgcagcagcgcataggcctggggctggaagggcttgagcagtttttccatccgatgtctccggggagggaggggtgcgcggtcgcgtgctgcggcgatgtgccgcgtcgcccgcatcctgcgccggacatgcgcctgccgcagtggccttcgccacagccccgcattccgtgtctattggcgcgtcagaatggccccggtgatgatgtcgaacagatgatcggcacgcggcaccagcggcggctggtcggccagccaggccagcgcgctgatcagggcgaagaggtcgttgccgtccatatcggcccgggcggcacccgccgcctgcgcgcggtgcagcagccgtgtgccggctgcgcgcagccccgtgcaggacccgtgcagcgccgagttctcatcgccgatcgccgccaccatcagcgcgatggcgccccggtagtcatgggtcatcgccaccgcttcgcgcagccaggtggcgagggccgcgccctgatcctcccgggcttcaagctctgccgcccgcctggccagcgcgtcgaagccgttccgcagcagcgcgtcgagcagcgcctcgcgggtcgggaagtggcggtaaagcgtgccgaggccgacgccggcccggcgggcgatgtcgcgcagcgacgcctcggcgccttcttcggcgatcacctggcgcgccacggccaggagctgatcgtagtttttccgtgcgtcggctctcattcggcctcttgaaaaacggagcaccgatccggatataaccggtgcactgctccgtatttaatagcacagatgccatcatggagaaagcgatgccgggcgagatgatgaaagcggtcaggatccaccgtttcggcggtcccgaggttctggtttacgaagacgtcccgcgcccccgcccgggcccgggtgaggcgctggtgcgggtgcatgcggtggggctcaacccgcccgactggtatctgcgcgacggctatcgcgccctgccgccagaatggcgtcccgcgggcggcgtcccgatcatccccggcacggatatttcgggtgtggtcgcaggtctcggcgagggcgtcaccggcttcgccgccggcgatgtggtctatgcgctggtccgcttccccgagggtgtcttcggcggcagcaacggttatgcgcagtatgtcagcgtgccggccgcccagctcgcccccgggccggcgggcatcgaccatgtccaggccgcggccgcgccgatgtcgctgctcaccgcctggcagtttctggtcgatcaaggccatgacgagccgaacccgcttcagcccgcccgccatgagccggtgtcgctcgacggccgccgggtgctgatcaacggtgccgccgggggcgtcgggcatttcgcccttcagatcgcgaagctgaagggggcgcaggcgattgcggtcgcctccgcccggcacaaggcgctgcttcgcgatctgggtgccgatcaggtcatcgactaccgcgcgaccccgccggaagatgtcgtccgggatctcgatctggtggtcgatgccgtgggcgggccggccaccggtcggtttctcaagaccctgaagcccggcggcgccctgttcccgatcttccctttgggcttcgacggggcggcagaggccgcgcggcagggcatcaccgtctccgccacccaggtccgctccagcggtgcccagctgcggcagctggcgccgctgctgagcgacggccgtatccgcgcggtcatcgacagcacatatcccctggcagatgtccacaaggcgcatgagcgtgcggagcgcggccacattcagggcaagatcgtgctcaccgtcgactgacccgccgggtgcgcgcggctcaatccagcccggtcttgcccggtgcccaataggccttggcgcggatccgtgccgcgggcacgccgatcgtcttcaaggcccggctcatccgctggatcgacgaggccttgccggtcagcgcgaagcggacccgccgggcggcgaggcgggtcagttcggcctccgccaccgccagatgggtgtccccggcctgccggccgatcacccgcgcgccgttgagccccatgcgcgccagcaccagccgggatgcggccacgtccgtcacttcgaacagatgtccttcggcatcgccttcggcgccgagcgaggctgcgagcgcgaacgatgtctcgtcgccgaacaccaccaccggccccccggcgcccgtcagatccagcgagcggcgcgggccgaagacgtggcacccggcgccggccgtcaaagcggccgcccagcggctgcccggtgccgcgcccgacgccgcatcctggtcgtgaagataggccagcagctgtgtccgcccggcggcggcatcccagaaaatcggggtataggtccgggcggtcatgccggttcccatcgccacctgcagcttctggccgatggtccaggcgacatccttcagcgccgtcccctccagcgtgatcagccggaagtgcggcgacagcgtctccaccgcggcgacccgtgccgggcgcatgaaccagctctgcagggtgcgggcgatccggccgggctgcggtacggcatcggtgcgcggttcgaaggtcgaggtcatggcagggctcctgtggtcgggcgtcgatcttggcgtcgggcgccgatcttggcgtcagaggcaagataggcagccccggcgctgaccacattcgttcaaacagacaaaatcttgcgatatccggtcaatccgcaccgttcccatcctgccgccgccgctcggccagatagcgtgccggcggcttgcccagcgccttgcggaacatggtcacgaaggcgccggcgctttcatagccaagctcctgcgccacgctttgcacggcggcgccctgatccagccgttgcagcgcgatcaggatatgcagctgctggcgccagcggccgaagctcagcccggtttcgcgcgtcagcgcccgggtcagcgtgcgcggggcggcggccatgcgcttgccccaggcctcgatcgtcgcacggtcggccggatcggccatcagcgcggccgcgatacggcgcagccgcggatcctgcggcatgggaaaattcagctgctccaccggtgcccgggccagctggtccagcagcacggtcgcgatccggccgtcgggcccgtcttcgtcatacatcaccggcatgtgggccgcgtgccgcagcagctgttccagcagtggtgagaccgccaccgtgcagcagccggcgggcagggccggcgcggcatcggggtcgacgaacaggcaatagatctccaccgcaccgctgagcgctgcgctgtggggcatgccgccgggaatccagacggcacagcgcggcggcacgatccacaccccgtcatcggcctcgcagcgcacgatgccccgcagggtgaagatcagctgggccttgcgatgaaaatggacgcccatttccttaagccccatcccggccaccaggtcggcgccgatggcggtgatcgcccgcggcacctcttcgggcgagaatccggccttctcgacggggtcgggcgcatgatcgaaacggtagaagggcatcgccgtctccgctcagccgggccggtggccgcggatcacatccagctcggcccgcgtcgccacgatcctgaccgcgatcgcaccgccgcggccgcggatgtccagcacccgatgaccgatccgccccaactcggccggtcccgggccccggccgccggccaccacccccgccaccgtcgcctccgacaggatcagcgtgcagcgctcggccttggtcgcctcttccagccgggccgcgacattgccggtatcgcccagaaactggatcggccgcggggcggtcacgccggtggtgcccacaaccgaagggccaagatgtacgccaattccgatacgaagtggcgcatccagctcatgccgcagttcggccgacagcgcttccaccccatcccagatcgccgccgccgcggccagcgccgcccggcaggtggccggcacgtcgtccaccggcccggtgccgccgaacacgctcattaccccgtcgccggcgatgccggtcacccggccgccggcggcggtgaccgcctcggtcaccacatcgacatagcgctcgatcagatagagcgcgtcataggcggtgcgttcggcggcaagccgggtggaggcgcgcagatcggtgaacagcgccaccaccatggcctcgcgggcatggccgaccagcccggcggcgccggtgcgatcctcgaccatggctccggtgaagcgggcaccgggggggatcagcggctgcacggtcagatcgctcggcggcctgagctggcaggccaggcgcacatccccgggcgcccggatccggcgcagcatctccgcctcaaccgcccggggcggcggcagctggtcgcggccgtccagcacccgcacccggcaggtggaacagcgcccctggccgccgcagatcgcggcatgggggatgcgggcgctgaggctggcttccagcacgctccagccccgcggcaccgtcaccacggtctcgccgccatcggcggcggccgggccggcatagcggatgcgcaccgcgcggaaatgccgggcatggccgtcgcgcagcagccgcccggccagaaccccgccgaccagcagcacccaggcgccggtcaggcattcgacccaggggccaaggcctgcgcgggccgccgccgccacctcgggtgcgaccgcggtcatccgggcaagttcggggtcgcctgcggcggcgcgggcctggatatccgccccggcgatggcgatgccgatcaccgccagcaccggcaccaggcaggcggcgaccagcagcagatgcgaccttgccatgaaccaggtcttgaaccgcagccagcggtagagcccgatgcagccatgcacccagaccacgaccagcagaagcagttgcagaaacaggttgatgccggcctcgggcagccaatagccggcgagcagccgccaatagctgtcgtccagcccatagagcatctcgcccagccgcacgctgacggcatggcggatcacgatcagcgggatcagcagccccagccccagctgccaggcttccaccgccgacatgcgcagatgccgccgccgccacagggcgtgcagccccagcgccgcatgcacggtgaaggcgccataaagcgcggtatggccgatccagcccttccagggcaccagcagcacccggctggtcgcctccatggccggcgccgtcaggatgcccgaagcgtgggtcagaaagtgacagcttgcatagaggaagaggatgatgcccgatatgatgcgcagccgggccagaaccggcgcgggcggccgcatggcgccaccatcgccggccccggcatccctgcgcgcccatcggccagcccaccatcggcccaacgcccatcggccagcagaccacgggaaagatatgcgacccagcatggtcagacgcaccgacccccgttccgccagggatagcctggcacgtatccctctgttcgcggcgctgtcgcccgaccagatcgcggcactcgatgccgcctgcagctggcggcgggtggatgccggcgcggcgatcatagatcatcaggacgacggaaccgatgttttcttcgtcgtccacggccatgtccgggtgatgatccgccagcccggcgggcagagcgtcattctgcgcgacatcggcgacggcgagtttttcggcgaactggcggcgatcgacggccagccgcgctctgccggcatccaggcggtcaccgccgccacagtcgcccggatgcctgcggccaccttccgccgcgcgatccacgaccatcccccggtcgcagaccaggttctgggcctgttggcggggcaggtgcggatgctggcgacccgcgtcaccgaattctccaccctcaacgtccgccaccggctctatgccgaattgctccgccagtcccgcccggacccgcgcgagcccgcccatgcgatcatctcgccaccgccgatccaggccgacctggccgcccggatcagctcgcaccgcgaagccgtctcccgcgaactcgcagccctcacccgcgccggcctcctcgaccgccgccgcggcgccctggtcctgctcgaccccgcccgcctgcgccagctggttgaagaggcttatgcgggggggtgagggagtatctcgggacggcggatcagaaccggccgcttctcgcctgttccggggacgtcctcgaatgccggatggcggcgcctgcgtgacaggatccggtgcagtttgtcgcgggtttcaggggtgacaccgtcggcgcagcgccccgcgacatcctccagaactttccgcgcccgggcatcggccagcaccatgtgcacatggcgggcctcttcgggtgtcagatgatcgtcgagcgtgaccagctccatgggggcgagtccggcgagcagctttgcctgaagctcgacctggccgccgagcatcagctccagaaggcggggcggtggtgcgaaccagccgcccacaccccaggaggtgaatcgctgacgccagcttcgctgcgggggtgtcgtggtggtcccgatggtgacgatgcgctgggcattgaaggggatgcggaatctctgcgacagatcatgagcggccagcagggcagggccgttggcgacgagggcaccatctgcgtagtggtgatccccgatcttgtggcgtggcagataggtcggtgcggcggccgaggccagcaccacatcgacaacagagatatgtgcctgatccggatcgtaactgcggaagatctcgggctttcccaggctctcgttgattgtcgggatcaacagggcatggtccagatcgccgagccgcctgtcgcccagaatggcggtcagaatgtcgcggagcggcttcggcgagaagcgggcgccgaggatacccggcgcggtcgccagaatcttccgcctcgggaagattttctccccgttctgctgcatgatcctcgcaatcgccgatgccgtcagtccggcggcaaggccggcggcgatgattgaacctgccgacgttccggcaagcaggtcgaaatgtccggccacggaggccccgggctggcggccgggtatcatctcctcgatccggcacgccatgagcgccgagaaataggcaaggaagccgccgccctggaaggcgagaacacttgcggtcgccggatccccggcgtcaatcggtccagcgggcggtgacatgaaggccggacctcgacagtttctccatcatcttccgatcatttggtccgtcctgaagcagcagctccgcatcctggacacggcagatggcgatggtctgaaggagatgcggatagacctcagggaggatggcgcggagcctggacaggagcagcaattcgttccggccgaccgtgaacagcagatagcgcggtggcggaatggcgagaccggaggccgggttgccgacggtatggtcgagcagttcctgcaggcggctctcgaaccggaggcggtcttccggcgcggcggttgcggccagatccgccacgaaggccagggcaggggccgcaagggcgatgcgctcggatgtgttggcggcaagaaatctcagcgcgggatgctgcctgctgccatcgacgatctgcatcgtctccttcggccccggcaggatcataaaccccgctccggcttcggtaagatgacggggcggccgagcacatcggcgagagacggcatctcataagacagggacggcggatttgccgccagcgcatgcggcggcccgtcatgtgccaggtgctcgtaaagatcacccgccgtcgccagcttgggctggagcgtggtcacaagggcgtcgatcagcagggccaggcggtcgcggccgatcagcacggcttccgggtcgtcgcctctggtttcggtcaggccgagaggcccggtcttgtccagatccgccagaacccggccgggatcgcgttcgaattcggccagcgtcaaccgccggtcctgccgcgtgttgtagaggtcgagaaggatccgtgcgatccggaccagtccttcgccggcgggcccttgtgccagttcccgcagccgggccagatcgatccggcgtgcggccgcagcgagcgtgtcgtcaggctctgccatatcgccccccccggctgtcgttaccacttgcgatgatatgggggtttcaggcgtgcgatcaatcgcttgcggcgatcctgcccctgctttgttcctatcccgcctccacccgataccgccccgggctctggccggtccatttgcggaaggcgcggtggaaggagctggggtcggcgaagccggccgcggcggcggcgtcggcgaccgaggcggcggggtcgcggaggacgtcgatggcgatgtccaggcgcagcgcgtccttgatcgcccggtagctctggccctcggccgccaggcggcggtgcagcgtggcggtggagatgccgaaggcggcggccaggctgtcgatatccggccagtcgtcggggtgcaggccgcgcagatggtggcgcacccgcaccagccaggcatcggcattgcgatagcgcaccagaatattgcccggcgcctgtttcagaaagcgggtcagggaccggcgcgagcggtcgatcggcaggtccagcagctcggcatcgaagaccaggcggctgtcgggttggccgaagcgcagatcgttgcagaacaaccgtcggtaatcgtcggtataagccggcacccgtgcgcggacatcgatccagcggatcgggatccgccggccgaccagccagcaggcggcgccatgcagcatcagccagatggtgaaatcggcgaaggcgcgcggcgggggcaggggcgccccgccggtggggcggcggccgcgcatcaccagctgggcatgggcgccatggcgcagcaggcgcaggtcgatatcgtcgaagaccagcatcatgaaccgggtcatgatccgcagtgccgcgcccagatccggcgcctcgcgcgcggtggcgcacatgaagccgaagctgccgcgcttcatccgccgccggttcatcgcgaagaattcatcgtccagcagccgggtcagcccgcgccacagccgggcataggtttcggcatccacccgcgcccccggccgggtcagggcgaccgggtcgatgccggccgatcgcagcaccggcccggtatccagccgcagccgatgggcgccttccagggcttccgccaccagatgggccgaaatcgtgccggccgggacatcgccctcgcccgtgttccgttgtccggatccgttgtccgtggtcatgcgtcccgccggcccttcgcccgccccctgtcctgtgggtcaggggataaaccggaagtcgcccggggtaaagcaggcagtgcgcattgcgaccccggatcacccgccctcgggtgtggcgccgcctgcgggccaggcggcgagggcctgttcggcgatcgcctccagcttctcccgactgaaccccgccttggcctgcaccgccatgccatgaagcgtggtcagcaggaaggcggcgagcacgtcgggtcgggcgccggatggcaggtcgcccgcggccttcgcccgctcgaagcgggcgcaaagctgcgcctcgccggcggcgcgggcctcgatcagcatctgccgcaccggctccgcatcgtccgacccggccagcaccccgttgatccccaggcagccggtatgctcgggatgacgggtgttgaggtcgatggcgctgaacaggatatgccgtgccacttcccgggcggtcggcaggttcagggcggccggaatgtagtccagatgacgttcgtaatagcgggccagtgccttgcggaacatctcttccttgttgccgaaggccgaatacagcgccggccgctccaccccggccgcccgggtcaggtcggtataggacgcgccttcatagcccttctgccagaacacgcacatcacggcgtccagcgcctcgtccatatcgaattcgcgacggcgccccatcagcccggtccggaaatgatcatcggctgcatcctaaggcgcttgacagctcctgtccatatttcataccaatcgttatcataatgattagtatgaaatgaagcgctctctggagcgccggaaacggaggtctcatgtcgaagatgtcagcttcgaagatgttggcgggcagggtggcgctggtcaccggcgggtcccgcggcctgggcgccgcggtggcgcgggcgctggctgatcagggggcggatgtggcgatcagctatgtcgcctcggccgacaaggctgcggcggtggtggccgatctgacggcgcagggcgtgcgcgcggcggccttccgcagtgatcaggccgataccgccgcggcggcaccgttgatcggccgggtgatggccgaattcggccggctcgacattctgatcaacaatgccgcgatctcggtgctgggccagatggtggacgatccggccgccgacacggcgcggctcgaccggctgtggcagatcaatctggccggcgcggtcgcaaccacgcgcgccgcggcgccggtgctgtcggatggcggccggatcatcttcatcggctcggcgctcggcagccgtgtgcccttcccaggcgtcgccgactatgccggcagcaaggcggcgatcgccggctatgcccgcggggcggcgcgtgatctggggccgcgcaacatcacggtcaatgtcgtccagccgggcatcatgcccaccgacatggcggcagaggtgggcgacagcgtgcccgacgccctgatggacctgcaccccatccgccggatcgcgacgctggacgaggtcgcgggcctggtctgcttcctggccgggccccatggcggctacatgaccggcgatgtgatcgacatcgccggcggcattcaggtctgagacgccccgcgccttgccgccgatgcggcataggtcacccgccgcagccggttcagctctcccagcggccggtgggcggcaagggcgttccagggggtgaaggcggtgtcgcggccgcgcccgggttccaccggctggggtggtagctccagccgggccacggtcgtgaacggcccggtccagcgggcgatgccgtcatccagcgattcgtgctcgccctggcggggctggatcaggaaatcgaagccgatcggcccgcgggcgaaggccttgcgcagccgttcggcgaagctgccgccgcgcacattccgccaggcggcatccggccggcactgaaacttcatcgcccccgcgcccagcgcgaagggcgccaccgaatgatagatccgcccggccagatcgcgccccttcaggtggttgcgcagcgtgtcggccatcatctgcagatagtgcaggcgcagccgcccgcgcggcatcacggcgccgggcagcagcatgcggccaagcgtcggcttcagatggccgtcgatcgcccggaacagcaccagcgcatcggcggcatcgcgcatcgccggggtcggctggtcgaccatcacgaaatcctgccggccctcaggcgcgccctcgcagacctcccccgcgatgcccgacacggcgatcgccatcccgcgcgcatccggcagccgttcatccggcaggagcccgcccgagaaccgcaccagggccttatactgccctggccgggcgaacagccccgcggccagggccggatctgcgggcggcgtgacggtgaacacggcgtccaggcaggcatgttccagctcgtgaaaggttcgtggcagcgacccgtccgggcgcggcagctgaaaggtgcggtggaaaatcgtgaccagctcgtcgccggtcgcatccagcgggcagcggggtgcgtctgcgggcaagggcgcatcctccggtcggtcggtgggtgatccatatccccgatcctgaccgtccggcggcctggacgcaaccgtcagccgcagtcgccgcggccgggcagggggcagagcgtgccgcaatcggcaaaaccctccagctgatagcgcaggcagcagattttgcggcggaacgcgccctccccgggctgcacctcgtccggcggacgcctggtcagcatgcccttcagcgggttgaccagcccgtccgcgatccggtcgtggtccagcagacgggtccgggcgcgggcggcaagggtggcatcgccgcggatctccgcgccaaccccggcggcccaggccaggatcgaagcggcattgcaccacagcagacgcggcgatatccgccccgcttcggcaaggcggtcgaagaccggcagcaggtgatcgctgatcaggctgtcgatcacctccagcggatcgcctgccgggacgagttggtgatcggccgcgatccggaagccgcagggctggccggtcggatcgcaggcgatccggcaggtgtcgggggtgatcggcagccgcctcccggcgagcatcgccgccgccaccaccggtacgccgaccacgccgcagtaatactggctccacatcgatgccgcggcccgccttgtggccgggacggcggccggaccgcagcggcgggtgaggatttccgtcagatccgggcgggccagcagttcggccgccgtcggtgtcggcaccgccggatcatccgcggccagcacgcccgacagataggtgaagctgccggtgaagcagccctgcagcgccgcgatcatggtcatcttccctcccgcgggctgcggcccagcaacaggatcagccagggtccgccgatcagggccgccatcagccccgccggcacctgatagggcgccaggatcatccgtcccgcctgatcggccgcgatcatgatcgcggcgccggcaattaccgcggccaaaatctggccgcgtgcgcggccgaacccggagagccgggccagatgcggagcgatgacgcccacgaagctcaacggtccgaccagagcggtggcggcggcggtggcgaggcagaccagcagcagggccagcgcccggacgggtgtcacggcgagccccaccccccgggcgacatcggggccgagcgccagcaggtcgagcggccgggccatggcgagagcaagagccggcagcagcacggcacccgccgccgcggccatcgcctggtcgggtgcgacaccccaggtggagccggccatccaggccatcagcccggccatgcgcgggtcgccgcttgctgccgccaccgccaccagcgcggtgccggcggtgccgatcgcgacgccggccagcagcagccgttcgggggcaaagcggctgcgggcggcgctggccatgaccagagcgagggcggctgccgctcccgcggcaccggcggccagccgcgcggggccgctgccgccaccggccaggaacagggtggaaagcaccgttgccaggatcacgcccgaggtcaggcccagcacttcgggcgaggccagcgggttgccggtcagccgctgcagcaccgccccggtcatgcccagcagaccgcctgccgccagcgccgccaccacacgcggccagcgccagggcagcagcacctccagatcggccccggtcgccagatgcaggccgtcggcgccgcggccgaccagcagaccggtcagcgccaggcccagggcggccaggccgatggccaggaagatccgaccagggcgccaggtgcgactgtcgggggccggggtctccggtggtggcgccactggtgacggcgcctgcggcaaccagccgcggcggccgagcagcaccatcagcagcggcgcgcccagcaccgcggttaaggctccggtcggcagcatcggcccgtcgagcatgcggccgagggcgagggtgatctcgtcggcaagccagagcagcgcggcaccggtggcgggggccgccaacagccgggggccgaggcgggtgacgcccgccagcctgaccagggccggggcggcaaggcccacgaagccgatcacccccaccgcggccgagacagaggcggagaccgcgaccgcaaggcccagcgccagcagccgcaggcgggcggtccgcacccccagcccctgcgcgccggtctcgcccaggtcgagcagggcgagcggccgcagcagcagcccggccgcgagcgccgcgaggaccagccgcaccgccagggtttctgccgcagaccagccgtcctggaccagcgagccgctgccccagatcagcactgcggtcagataatcgtgattgaacacggtcaggaagccggtggcggcgccgcagatcagcgtcacgatcagcccggccagcaccacccggaccggtgccgccccgccgcggccgccgatcgcgagcgtaagcccgatcgccgccgccgatccggccagggccaccatctcccgccccgcgcccagcagggacggcgccgtcagggtcgccagggccagcgccagatgggcgccggccgaaacgccgagcgtcgaggggtcggcgacgggattgcgcagcacctgctggaacacggtgccggccaggccgagcagggcgcccgccagcagcgccaccgcgatccgcggcagggtgccggccaggatcatcacccggtcgatccccgcggcgggcagaaaccccgaagccggcagcaggggcacgagccccgcccaggcgaggccggccgcggccagcagcggcagaagggtgaggcagagcagcgggcgcgagggcagcggcatcatggcagatagctcatcggccggccggaaaccggatgtggcatcacccccagttccagcccgtagatccggcgcagcatctccggttgcaggatgtcgcaggccccgccgctggcgacgatccggcctgcatccagcgccacgatgcggtcggcgaagcgggcggccatgtcgacatcgtgcagcaccatcaccaccgccaggccgcgatcccgggcaaggctgcggaccagggtcagcacctccacctgatgggccacatccagggccgcggtcggctcgtcgagcagcagcaccgatgcctcctgggcgagcgccatggcaagccaggcccgctgacgctcgccgcccgacagcgcgtcgacctcgcgatcggccagggcgtcgagcccggtgccgcccagggcgcggccgatcgcggccgcatcttcggcgctgcgccggcccagcgcgccgtgatgggggtagcggccgaaggcggccagttcacgcacggtcatgctgggtgccggcggcagggtctggggcagatgggcgaccagccgcgcgaaccgccggggtggaatgcggtggatcggtgccccgcaacaaagcgcctgaccccggtcgggccggcggatgccggcggcaagccggatcagcgtgctcttgcccgatccgttgcggccgatcagggccacgacctcgccggccccgatctccagatcggcatcggtcaggatgcttcggccatcggccagaacggtggcgcggctgatttgcagaagtggagcggtcatccggcctcccttcgaccggcgtcactggcgtcactggcaccggtcagggcatccgccagctggtcggcgaagcgggccatggtcggcagggcgccgaaataccagaacggaccgatccgccgggcacggccggcggcgaccggcggcaaggcctgccagatggtcgaggccccggtggtccagccggtttcggtcaccggcagatcggcatagatcagccggcaatccggcagcgccgccagccggtcgatgccgatggcggtatagccccagaagctgcccgggccggtccaggccggtgtcagccccatccgggccatcaccgccgcaatgaagccgttgcggtcggcgatccagccatggcgcgggtcctgaaagatgaacacggcgaccggcagccggcgcaagccctcgccgacccgggcggcggcggcatcgatccgggcgagggcccgcgcgattgccggctcggcggcttcggcccggccgagcctctcacccagatcgcgggtcacctggcaggctgcatccagcggtgcgccgtcgccggtatagatcgacccctcccagaccggcgcgatgcgggccagcgccggcccgatcgtctctgcctgaccgtggccggtgacgatcagatcggggcggagcagcagcaaccgttccagatcgggctgggtcatcaggcccagatcgatcacatccccgggcagatccggatcctgcgcccggtcgcgataccggcccggctcgaccatcgcgaccggcggccgtccgagtgccaccgccgtctcggccatcgcccaatccagcaccgcgatgcgccggggggcgggcgtggcgaggcgcggggcagcggccccggcggcagggccgccgagggccatgccgccgaaggccgccaccccgcgcagcatctgccggcgggagagcgacaccgccgctctcaccagcgatagcgcaggctggcgatcaccgtccggccctcgccgcgatagcaatagccgtcctggcagaccagcacctcgcgatcgcccagattgcgtgcattcagctgcagccgggcgccgcccagatcgtagtggatcacggcatcggccagggtatagccgccattcgtggtgctgttggtggtgtcggtataggtctcgcccacatagcgcaggccgaagccgccgcccagcccggcgaagctgccggtctggtgggtgtagtccagccaggccgaggccagatgttcgggcacgcccgtcggccggttgccctggtcaccctccaggctgcgggtgatctccatatcctgataggcataggcggcccggagcttcagcccgtccatcagttcggccaccgcttccagttccagaccccggctgcggacctcgccgatctggcgcggcagcagatagttgccgttttcgtgggtcaccacattggtcttggtcagatcgtagagcgaggcggtgtagatcgagttggtgcccggggcctggtacttcaccccgatctcgatctgctccccctcggtcgggcgcagctggttgccgttgacgtcggtgccggattcgggattgaacgaggtcgcatacgagacatagggggcgaggccggactcgaacatgtagagcaggccgacgcggccggtggtggcatcgtcttccgatcgggtcacgatgccggtctggcggtcgcgggtgcggttggtggcgttgtcgtggcgcagggccagcgtcatccgccaccggtccagcgccagctgatcctggatgtagacgccggtctggttggtccgcaccgcgctcagcgtcagcacggtgtcgggatggggcacgtactggctgtaatccgggtgcctgaggttcagcgagggggcgtcgccgctcagatagtcgatcgtgccgtcattccactgatagtccaggccggtgagcagggtgtggctgaccggtccggtgtcgaagcggaactcggcctgattgtccacacccagcgtctggatggtttcatagacgccgatcgatgtccggttcagggtgtagccgtcggcctgcagcccggcggggctcagatactggttgtcggtgtcgacctcgccatagcgcagattctggcgcagcgtgatgtcgtcggtcaggtcatgggccagtgaatagccgaccatcacctgggtctgctccagtttgtcgaagttctcgtcgccgccccagatccgggtcagtccctgcaccggatcgtcgtacgggcgcgggctggcgccggtgcggtcgtgctgatactggccgtagacggtcagctccgtggcgtcgccctgccagcgcagcgagggagagagcatcacccggtcgtcgtcgatctggctgatggtccgctcgctgtcgcgcgccaccgtcaccaggcgataggacaggctgccatcgggcaccagcctgtcgcccaggtcgaactgggtctgcagacgataggggtcgccggtcagaaactcgacctcgcggatcttctcgccggtcggccgcttgctgacccggttgaccagcccgccgacatcgctctggccatagagcaccgaggccggccccttcagcacatccagccgttccaggttgtaggtgtcggtgcggtaataggccagccagccggtattgggctgcttcaacccgtccagatagtcgccgctttcggtgatgctgaagccccggatctgaatctggtcgaagcgcggatccatgccccagccggcgatctgaacgccggcggtataggccagcgcatcctccaccgtctggaccttctgatcggcgatctggtcggcggtgaccaccgacaccgattgcggcgtctcgatcagcggtgtggcggttttggtgccggtgatggtgttgctagcgacatagccgtcgaccgggccgacggcgccggccagttttgcgtccatcaccaccagcggccccaggctgaccgcgccgtccgatgcggccaggatggtggccgctccggcccccgaaaaccggtagtcgagcccggtgccggccagcagccgggccagggcctgatcggcgcgcatggtgccgtccaccggctgggagcggcgcccggcggtcagccccgcatcataggccagctgcacgcccgaggcggcgccgaaggccgccagcgccgcatccagcggctgggccggaatgctgaaatgcagggtcggcaggccctgtccggtttcctgtgccgccgcctctggcatctgcccggccagcgccacggcgctcagcaccagtgccgtcgcccccagaaccacccgccggccaccggccgcactgccccgcatcgtcgccattcccgctccctccttcagacccgggtcggcgggcctgtcatgcgaatgtgtctcatgtgcatgacgggcgggcggcggcggcgacgaatcggcggggtgtaaattttacgaaaaccttgtccctgaagtcggctcagatctcttcgaccacggcggtgaagacatagccgcccaggcgcaccgtgcgcagcagggcgggttctttcgggtcggcttcgatcttctggcgcagccggctgatgtgcacgtcgatgctgcgctcgatcggcccggcgagaccggcatgggtcagcgacagcagttcttcgcgcgtgatcacccggccgggattgcggcagaaggcgagcagcaggtcgaattccgtagtggtcagcgcgatgcgggcacgggaggggtcgtggagctggcggcgcagcgggtcgatctcccagccgtcgaagcgcagccggcggcgggcatcgggcagggctgcaccgtaagaggcgcggcgcagcaggctgcggatcctggccaccagctccctggggctgaacggcttggtgacatagtcgtcggcccccacttcaagcccgacgatccggtcgatttcttcgcccagcgccgtcagcatgatgatcgggatggtcatctccgcccgtatcctgcgacacaggctgacgccgtcctcgtcgggcagcatgatgtccagcacgatcaggtcgaaaccctgccggctcagggccgcggtcatgccgcggccgtcgccaaccaccgtcgcctgcatgccgctttcctgcatggtcagggccagcagcccgccgatcccggcatcatcctcgacgatcaggatccggggcaggatacgggggccggcggctggctgcatcttcgtcacctcgtcccgatcttcagaaccggtagcccagcgccagtgaaagtttcggctggaccttctcttccaccaccgggctgtcggcggcatcgccggtcagcacgcccacacccgccgcaccgcgcagcagccagttgtcgcccatcatccaggtggccgtggtctcgaattccacccgcttcagcccggcctcggcatcatagcgcgccaggcccgatgcggtggactggcgggcatcgatgccgaaatagctctgcatatgcttatcatcggccatcaccgcggccacacccgccgtcagggtcaggcgctccgacacttccatcgtatagtcgagccccagcgtgcccgtcagcccgtcgttgccgcccagcgcccggtcgacggtcagatacacttcgaagggctccgggttccaggcgagtttcagcccggcggtggcggcgccatcgacatcgcccagccctttcagccggtcggcatcgtcctggtcgcggccttcttcatagcccagccggcccgagaccgacaactggccccagcgtgcgacacgcgcctcggcgccgccgggggagaccgtcagccagtcctgccaggtgaagagtaccagcggcacgggcgagacctccatatcctcgccgccttcgtattcgggggcgagttcggcaccggcgccgagcaccaggctccagtcgcgggcctcggcaccggccggccggatgatgagaagggcgaccgcagctgcggccggaagaagggaggtggtatggcaagcgagacgacgcatgacggctccgtgcgacgatgaggaccgatgccttctgcttcccatattgcgcggggccgtgggggtgtggatttgttacgttttgttgcggcgcaaccgcggcggcccgcgacatgcgaagatggcggccgccacctcgttcaccccatacgccggagcgggcatgaagcgcgtcacgataccgcgaccgacattgcagatacagatcatggtcatcatcctgattggcctggcggtcgtcgacacgttcggtccgatcctggaacgccagatcaagagtctgtcgaccctgccggacctgaagcaggtggccaggcaggtcggggtcgtggccgatctggtggaggacagcccaccggcggaacgcgacgccgtgcttgctgcagcgcggcggtcgggctgggttctgtccctcgcagcccccgagacggctgaccggttggtgacgggactgcccgaggatggtgttttcgacaggctgaccagctggttgttcatgcccgaggacatcgatccgccggtcggtggatggcgcaccttcctcgacgagacccgggtgatggtgctgaagatcgaccaggggcagaccctgctggtcgccaccctcgatcctgagcggatgatcctgcgcgacgtctcggcccaggtgccgtattacctgcttgccatcgtcaccctcggcctgctctttgcggccttttcggcccacgtcatcacccggccgctgcggcgcatcgcaaccgccgccgccggggcggacctgtcgggcgggaccgagatcttcgaggaacgcggcagcatcgaaatcgtgatgctggcccgtgcactcaaccgcatgcgccggcggatcgtgaccatggtcgagagccgcacccgcatgctgcgcggcatcagccacgacctgcgcacgcccctgacccgcatccggctccgcgccgaccgcatcgccgatgcggagctgcgcgcggccctgctcgccgatgtcggccggctggaggcgctgctcaatgaaagcctggcctatctgcgcgacgaccatgcccgcgaggcggtggagcgcaccgatgtcgccagcaccctgcagaccatctgcagtgatttcgccgatatcggccacgacatccgcttccacggcccgaaccgcctcgtcgcccgctgccggccgctggcgctgggccgggcggtggccaatctctgcgaaaatgccatccgtttcgccagccggaccgatgtcacgctcacagccggcgacggtgtcttcgtgatcgaggtggccgataatggcccgggcattccgccggacaagcgcgcccgcgtgctggaacccttcttcaagctcgacaccgcccgccaggacggcggcaccggcttcggcctgggcctcgccatcgtcgccgaaatcgtccaggcccatcgcggccagcttgagcttctggacaatgcgccacaggggttgcgtgtgcgcatgacgataccggtggggtgacgcgtcacgcgaccccccgtaccctttcgccccactcccggggcgggcggcccatcacccgcttgaaggcggtgctgaaggcgctgtccgaccagtagcccagatcgggcgcgatcaccgagatcgggtcgccggtggtttccagccggtcggccgccagcagcatgcgccagcgggtcagatactccatcggcgtctcgcccgcggtttcgcggaagcgggcggcgaaggccgatcgcgacatgccggccgcggcggccaggtcctgcaccgtccagcgccgggcgggatcggcatgcatggcgccgatcgccgcggccatgcgcggatcggccagcgcgaaaaaccatccgatgcgcggagggccagtgcgggtgggccccgcttcggtcatgcacaggcgcagcgcctggaccagcatcatatgggccagatggcgggcgatcagctggccgccggggcggggatcgtgcagctcgtcgatcatccgctccaccgcccagcgcagcgcctcgcgatccgcgggggcatgaacatgcagcacgggcggcaggctggccagcagcagcccggcgcggccggcatcgaccgcaaaccggctgccgaccaggaacatgccgccaccgccgcccagccgcgccacgccctggtcccgctgcacggggaagatctcgcgggatgaaaccggcaccaggcccaactcgctcgccagggtgaacgaccggccgctcggcattacgaagctttcccccgcctgcagccgcagcggatcggccaggccgtcgacggtcagccagcagccgccccgggtgatggcatagcatttgatatagccctgctggtcgtcgaagcgcacagcccagtcgccgccggcatcgaagccggccgagacatagctcttcgggcggagcagggaaagaatgtcggagagcgggtccatcgcggggcctcttcgggggagagcagcgccgccacgggacgatcgcgaagatattatggaggctgcagcatggatcgtccatggggtcgggcctatcctgcggcctcggtgttttaccgatcctgcagctttgcgaggttgccatgcatgtcttcgtcaccggtgccacgggtttcgtcggcacggcggtcgtccgcgaccttcttggggccgggcatcgggtttcgggcctggcccggtccgatgaggcggccgcatccctggcccgggccggcgtcacccccatccgtggggatctccgcgacaccgccgggcttgccgcggcggcagcggcggcggatggggtgatccatgccggtttcatccacgacttcaccgattatgtcgccaattgcgaaatcgaccgcgccgcggtgcgggcgctgggggcggcgcttgccggcagcgaccggccgctgatcgtcacctccggcatcggcgtgctgccccaggggcggctctcgaccgaagacgacgccccgcgcgccggatcgggcggcctgccccgcgtcgcctcggaagaggccgccgccgaggcgctggccggcggcgccagggtcatggtgctgcgcctgccgccctcggttcacggggccggcgatcacggtttcgtgccgattctgatcgacatcgcccgccgcacgggcgtctcggcctggatcggcgagggcgccaatctctggccggcggtccatcgcggcgacgccgcccggctctatcgcctggcgttggaagcggggcaggccggtgcccgctatcacgccgtcgccgaacagggcatcgcctttcgcgaggtcgcaaccgtcatcgggcaggggctgggcctgcccctgcgctcggtcacgcccgaagaggcgccggcccatttcacctggttcacccatttcgccgccatggacgtgccggcctcggccacgctcacccgcgagagcctcggctgggtgccgaccgggccggggctgctcgacgacatccggacggcgggctatttcgtcggatgatgaacgcggtgcgtaagggcggccggctgacggaccgggtcagccggcctcgccggcgacccggtcacccagcgccatcagcctgtcccgcggcaggtcgagcgacggcaccgccaggttttccttcagatgatcaaggctcgacgtgcccgggatcagcaggatgttgggcgcgcgggccagcagccaggcgagggccagctgcatcggcgacacgccctgcgccgccgcctcttcggccagcgctgccgattgcaggggggtgaagcctccgagcgggaaaaagggtacccaggcgatgccctgatccgccagacggtcgaccagcgcatcatcggcgcggtggacgaggttgtagtggttctgcacgcagaccaccggcgcgatccgctgcgcctcggcgacctgggcggcggtgacgttgctgagccccagatggcggatcagtccctggtcgcgcagccgggccagtgccgtgaaccgctcttcgatcgagccttcttccggcccgggactgtggccctcgacgattctgagattgaccacatcgagcacgtcgagcttcaggttgcgcagattgtcgtgcaccgcgcgctcaagatcggccggcgcctgcgccggcagccaggcgccgtcactgccccggatcgcgcccaccttggtcacgatcaccagatcgtccggataggggtgcagcgcctcacggatcagttggttggtgatatgggggccgtagaaatcgctggtgtcgatgtggttgacgccggcctccacggccgcccgcagcaccgcgatcgctgccgcaggatctttgggcgggccgaagacgccaggccctgccagctgcatggcgccataacccatgcggtcgaccatgcggtcgccgagcctgaacttgccggccgtcttgtgcgtcgtcatgatcgttcctccgggctttgcaggctgcgctcgtcggggcaggacgaccagcgggatcggcctgttttatcagatggccggccccgccgacaccggccccgatacgggcaccgacaccgacaccggcaccgacaccgacaccggcaccggcaccggcaccgcaatggtgcagtgaaccccgtcgggtcccaacgtgaagctggtcttcgccttcagctgatagggcaggccgcgttcgatcagggcgcggccctggcccccatcccccctggccccccatcccccctggcccccatccccctggcggctaccgggcggggtgggggcggcggcgggcatggtgatgccccgctcccgccagtcgatatgcagccagggcccctcatggtcgtcctccgcgggcgccaggtgccacgagatctgcaaccgccctgcgggctgggccagggcgccgtatttgaccgcattggtcgccagttcgtgcagcgccatggccagcacctgtacggtggaggatctgagccgcacctccgacggcccggtcagggtcacctggctggcggggtcgcccatcaccgagatttcggcgcggaccagttcgtcgaaggcgacgcggtcatgatcggtcagtcgcgacaacaggccctgcacccgggccagcgcgtccagccggtcgcggaaccggtgctggaaatcgcccagatcggcgctcgcccgggcggtcttgtcggcgatcgagcggatgacgcccatcagattgcgggtgcggtgctgcagctcggccagcagcaccttctggcgctcctgccattcccgctggccggtcacgtccatcatggcgccgaccatgcgcaccggccggccttcggcgtcatagaagaaccgcccgcgcccggcgatccagtgcaccgagccatcggggtgcagggtgcggaattcgctgacgaaatcgctcccgtcggccatcgcctcgtgcagtgcggcctcggtttcgccgcgatcctcggggtggatgcggcgcagccatgcctcgtagctgggcgtcacctcgcccaccgcatagccttccatcaggtagtgctcgtccgaccagtggatatgcccggtctcaagatcccagtcccacagccccagccgcgccaccttgacggcgatgcccagccggtcgctgctgctttgcagcgcgtcctgaacccgccgcgcctcggtggtgtcgtggctgatcccgccgatgaaggcgatccggccggtggcgtcggggatggggaaatccgtgttgcgcagccagcggatgccgccatcgccggggcggatcacccggtggtcgaaggtgacatggtcgccgccgcgcacccgggcgatcatcgcctcggtccgcggccggtcttccgccaccaccagatccagccagcgccggtaattatcccccgtcagcgcctgttcgcggccaaggccgtagatcgtctcgaaggccggggacagatagacccattgcaggctgtcggcatcgcggatccacagaacatcccgcgaggcctcgccgaagcgccgcagccgctcttcggtcgcgcgcagcttctccgccgcctggcgcggggcggtgacgtcggtgcccgacccgaaccattcgctgacggtgccgtcgggggcgagcagcggcgcggcacgcgacaccacatggccgatgccgccatcgggcaggcggatgcggtgttccagctcgaacaccgtgctgccgtcgatggccgcctgaacggcgctctgcaccatctgccggtcctcgggcaggacgaagcgctcaagccaggtatggttcagcgcggtgccggcggggtcggcgacatgcggtggcaggccggtctccatcaccgacatctgctgccagtccgggctgatccgatagaccgactgtgcggtcgccatcaccagggcctgaaagcgccggcggctctggtcgatctcggcctcgtggcgcttgcgctccgagatgtcgtggaacagcaccgcgacctggttttcgccgatccggaaggcatagacattgtaccagaagcccagcgcatcggcccgatgctcgaaacgctcgggcgttccggtcagggcgatgcggccatagatgtcgaaccagtgctgttcgtgatccgacgccagatcgcgcattcgccggcccaccgcatccgacaggccggtctggcgggcgaaggcggcattggtttccagaaacacataatcgaccggctttccgtccgcatcgaacagcatttcgatggtgcagaagccctcatcgatggaattgaacagggtgcggtatttgtgggcctcgccctgcaattcggccagccgcgccgtcgccagcgtcagccccacctggcgggccagcaggtccaggaagcggcgatagccgtcgtcataggaaagccgggggttcagcccgaccaccagaaagcccgagaccttgtggccatggtcgtccgtggccgccgtcagcggcagaatgacggcggattgcggcgccccggccgcggtggaggcggccggccaggggccggcggcaagccccggcccggccaggtcgatcaccccaccccgatgccctgccaggggggcggcaagcggccagggctgcgccgggccgtcggcatccatctcccagggggtgacggcggttccggccgcaagccccgcgcagccggtcagcctggcggtgcgcgtgtcgccgtccaggctgtagagcagggcaaaggccaggtcgcgcggctggtcgttcagcacggcgatgatcgcggcggcggtctggggcgcgctgcgggcggcccgggtgccgtcgcccagggcggtgagtgccgccagccgacggtcgctcagcatccggccggtctcgtcggtgcagatgccgaacaccccggcggtgccgccctggccgtcggggatcgggctgcacgacagggccatgcagacctcttccgccaccccgtcgcgggtgacgaccatgtccagccgctcgcgccggatcgcggccccgcccgccatcaccgccgccagggtggcgccgagatcgggccaggcggcgctgtcggtcgtgggccgctcatccgacccgtcctcgtcccccccgttctcgtccacagggaggccggacagggcagggtggtgccggcccagcagcgggatgcaggcgtcgttgtggaagcggatcagctccttcccccaccagatcagcatcggctggggggcggcgagcatgatcccgatcgcagaaatcaggccctgcggccatccggcctgggggccgatcgcggttgccgaccagtcgccggcatcgatctgcgcccgcatgctgccgtcattcgtcggcgtctgatgcctcagcggcatatgcatcgcatgggtcaccgctcctcgctttcatcgccatcgggcgtcttcgcgccctgcggctgatcggcggggccgcgccgccgccgtgcctcttccagcgcatccgccagttcatgcgccagctgccgcagccgcggcggaatcacctcggtccggcccggtatgcgcgagcttcgcagggggccggcttcgccgtccatcccgccattgcgcgcccatcgctcgcgcgcccatcgctcgcgcacccatcgcgcgcgttcttcgtcgccccgtgccggaccgccatttttctgatcgaccataaaccctcctggaccacctggcggtggccatcctgatacccgccaccccgtacccggatccctccgggggcctcgcttcagtgcagataaagccgtccgcgccggcggaattcgtcgtccagcgccgcgtgcagccaggcggccggctccgggcttccggcccggccgctccgggcttcggtgatcgcccggcgcagcgtcgcctccaccagccgttcggccgcgcccgggtcgggcagcagggtgcgggcccgttgcagcaggcccgagaccaccgcttccaggctctgcgcatcatccatgcggccgcccgaaaccgcatcggtgctgccgtcgcggtcgggcgccggcaggtcccgcccgtcctcatactgccggtgcagatcgtccagcagcgtgcgcgcgtgatgtggtttctgatagaccggccggccggcgaagcggtcggggaaaatgtcgaggtcatagccggtcagaaacacgaagggcacgcgccccaggaccagcgaatccgccaccgggaacgaggccagatcccggatcctcacatccagaatcgcgacctgcgcggcttcgacatgccggatcgcctcgtccatatccgaaaacggcccgaccaccgtatcgccgcagctgcggatatcgtccgacagcgtctcggccagataaaaatcatcctccagcaccagaaccttcagcgacggccgatcgatccgccgctccccgccgacctcccggccgcgccggccggcgctcacctgtacggcgctcacctgtgctctgggggccattaaccgccccggctcaagaccggcggcaggcggggcgggacgtgcggtcacgggcggggcggatggcatggtcgttctccgatggatctgactgttctcaggcagtcaatcggcgaaggcgctgcgggttcccgtataattcgagggggtggcgtttttttccggtggctttgcccggatcggggggcgggctacactgaaaccagggcgcgagccatggggaggccggtatgcagatcagaaaacaacccgagggtctgaccatcgccctgcccgacgagctggtctccgaactcggctctgaggcgggcgccaccctcgacgtccgcgtgaccgggccttgggctttcgacatcagccgtcggtcggatcgggaaagggcgattgagcggttgcgggcgtttcgggggatgttgccggcggggtttgtgtttgatcgggatgaggcgaatacataacgctccggccgccatctgtccggggccggagcgttacgaaggtcatgtcatatcggccgcgattttgacatctcgacctggatcgtggcttcaatccgaatcgtcatcatcgtcttctgtggcaccgtcgacataggcgtcaccgatgatcgtccggatacgatccgccatgatctgcgcccggcggcgcatgaagacttcgtagttttcaaccttgaactgttccagccaatccggatctccgggatttccaggaatgaggcaggcctgcattctttcgcggagggccccgaccgtgccggcttctttggcgctcagcagcctggtcctgaaatagtcgtagggagaatcgtcgccgatttttcggttcgtatctctgatgaccggaatcttgttggtaatggagtcgatatctcgttgacgtaccttgctcttcttgaggagggcacgcggaaaaatatggtgttcttcgaccatatcctccgatatcagttgattggtgaacagatcattcttaatagtcgcaaatatcagggactgtaggcctttatatctaacatccgctgcctgataaagatgcatgatggaatcgacattcatgtatactttatcaaaagtcggatttatttttccggatgaatatagacttagctctgaaaaatacagacccatcttgtaattaccggcctgtcgcgcaccctgctggagtatcttacaaaaataccacttccgcagggtgtcatcctcattgtcatagatcgacgcgctatcattgctgatgacgaacagggctgcgatcgcagtgagaatgttgtggctgggcgggtttggcgcgcgcgcgccattgcgttcggcccagcggtaagccttggcgagacccgtgatcgccgcgttccattcagacagtatgacgtctcttcccatcgtgagaagagtaccccgggagacttccggagattttccgctacgaaatgctgaaaccagcgcaatgacctgtagggcacgttctccatcgacagcaaaatcgtttaatattggatgaatttcttttgcactcttccacatagattgaagatctggatccggataatatttagcgacagaaagatcgaaggttgtgagccgtgttccggtggaattaattgtctcgaatatccggcagacgctttcgatcttggcgtcgcgttcgatcgtcacgaccggcagcaggtagcttcggaatctctcgaaaaccccgcgtaccttggccatctccgcagcggctttgcggcggtccccattgaattcctcgatcgtgtacagattgttgtcactgaactgcgacaagtagatttcacagtcgatctgactcatcacaacgtcggcgcgaatgaggtcctgatcttctttccgtgaatgtccattcttatccttgcgcttgcgcgtaatccaatccgtgccatcttctccccgcagataatgactcagcatctttcttacgttaaaatagtagctatgtgttggatcggcatccatgaatacacggacgatggatgtgactctctgttgcccgtcaagtatatagtattgctcagacggcatctcttctggcggggcttcgccagccgattcaccggcatcatcattgcgatcctcgaatatctcggcttggatgctgcgagaattcagtgttatgtcagccgtcttgggaagcagaaggatggatccaacaggataggagcgtgaaatcgagtcaatcaacagctttatctgtgcgttcttccagacgaaagggcgctgaaattgcggaatcgtcagagccttctctcgggcccgtcgaagtatgtcggaaatagtgaaattggccgtgtgcatgggcgcgctccgcatccgctctcaagagtgtacaagttatcgtacgctctctcgaccctcaaccattggccgaacgcacatgcgttttgcagcggaatggtcgggagcatcctccgcatgtgggcgaatgaggctgcatcgcattttcgggaagagtttagccccccacccccctcccaaaatccgtctctgccgcctcccgcagcgcatccgccgcatgctccggcgacggtgccgcctcgtcgggcagaggggtggtggcggaaagggcgcgggcgacgacggtcatgtagatgcgttccacctcctgcggcagcgggcggacttccgtgccggtgacgcagtagcgggagagcaggaattcgcgggcgcccatcagcatataggccatgggttccagatcggcgtcggtatagccgggcagttcgcccgcggcatgggcccggcgcagggcgcggacatagccttcggccaggtggtcatagaattcgcggtgggcttcgggggcgaagaattcggcctcgttggtcaggcggtgcagatgcgggtgggtggagagataggcgaaattggcctccagccccacccgttcgcgttccagcaccgtgcgggtgtggcgggtgcgccggcggatgaagtccagcatccgccggcccagcgtcggcagcaggctgtcgaacagagcctggcggttttcgaaatgcagatagaccgagccatgggcgatgccggcctcttcggccacccgggcgatcgaggtcttgtcgtaacctttctcgccgatggtccgggcggccgcctggatgatcgcctcgcgcacctgttccgcgcgctcgttgcgtctgcgccccgccatgaattccgtccttcggttgactgtgcggtcgtggacggccggtcaggtcttgtcctggactgcgtccgccaccatcctgcggatcagatgtttctggatcttgcccgacgcggtgcgcgggaaatcctcgacccattcgatccgttcgggaagtttttgccgcgccagcccccgcgatgcaacaaaatcggcgatcgcctcgcgatccggcagggcggtgccgtcatgttccgcatcgcgggccgcatcggtcgggatcagccaggcgcagaccccttcgcccagccgggcatggggcatggcgaccacagcggcttcgcgcaccagcgggtgttcgtgcagcgcgtcctcgatttccttggccgacaggttctcgccgccgcggatgatcagatccttcttgcggccagtgatcaccacctggcccgcggccgagaccgtgccgaggtcgccggttttgaaatagccttcggcatcgaaggcctcggccgtggcgtccgggtcggtatagccgcggaacagcgccgggccgcgggccaggatctcgccctccgcccccggcggcagggtgcggccggcatcgtcgaccaccttcacctcccagcccgtcaccgcgccgtcggtcaccgcggcggcttcggccgaggccgggtcggtaccgggatagccctgggtgatcatcgggcattcactcgacccatagacccggaaggcggcaaggccgggcagggcggcgcgggcgcggcgcaccacttcgggcggcaccgccgcaccgccgcaggcgaagatcttcaggctggcggccaccggcggccgcccggcggcgcgggcgctttccgcggcctgggtcagctcctgcaggaagggggtcgcgccgatcatcaccgacacgccatggtcttcgatcaggtccagcgccctactgccgtcccagcgctccatgaacacggtggtggtgccgtgatagaagggcagctccatgccataagagaagccggtgacatgggtgacgggagagggcatcaggatcacctggcccgcccggacgtcccaggccgccatggaattcagcagcgcccgctgcgaggtctcgtgggcatagagcacgcccttgggccggccggtggtgcccgaggtatacattaccatcttgagttgtgaggcatcggccggggtgaagtcgtcgccgaaatcaaccgcaccgtcgtcttcggccccgccccaatcctcccagctatcgcagccttccgcgcggccgcgcacggtgatgatggcctgaagatggtgcaggcccggcttcagcccccgcgccatggcggcatagtcgaaccgccgccactccgccggcaggaccagaagttttgagcgcgcatcccccagaatgaagcccacttcgcgatcgcgatagatcggcacgatcgggttgatcacccaggcccccagcgtgcaggccaggttcagcaccaccgcctcttcccaattgggcagctgaaagctgaccacatcgccgggcttcagccccgcctgccgcatctgccgtgccagcttcaccgcccggctcagggcctggccataggtcaggctgccggtttcggtgcgcaccgcaatctggtcgggggtctggcgcgcccggtcgcgggcataatcaaccagcgtgcgccccgaccattcgccggctgcccggcgcagccgggtctcgtccggggtgtagcgcaggcgaaagccgctcgggtcgtcgacaaggatgctggacatggggtgcggggtcctcgggagcacagggcgcggaacaacggcgatgatggtcacaagccgccattgaggcggcggccaaggccacggtagtggccgcccggcgagggtcgaacagactcccgccattgaggcggcggccaaggccacggcagtggccgcccggcgaggggctgaaagactcacacggccagatagcgggctttgagcgtcggatcggcgtcgaactcatgccagctgcccgaatacaccagctggccgctgtcgatcagatgcacctggtcggtcaccgcgcgggcgaaggagaggttctgttcggtgaccagcaccgtcagcccgtgatcgcggtgcagccggcggatttcgcccgccatctggtccacgatcaccggggccagcccctccaccggttcgtccagcagcagcaggcgcggccgggcgatcacgccgcgcgccaccgccaccatctgctgctgcccgcccgagagcgcatagccggcccgggccgcgaagggcaccagcgccgggaacagcgcccagatctcgtccatggtcatcggcttcacgcccgggcgggcggcatgcgcgcccagcgcgatattctcggccaccgtgatatgcgggaagatccggcggtcttcgggcaccagcatcagcccggcccgggcgcgggcatcgggcgcgagcggccccatatcccggccgtccagggtgatgcggccgccggtgacccgtggcccggcattcaggatggttttgagcaaggtggatttgccggcgccgttgcggccgagcagggcgacggccgagccttcctcgatggcgaggtcgatgccgtgcagcaccgcggcatcgccatagccggaatgaagcgcctcgatgcgcagaagcgggtcagccatggcccagatagacctccttgacggtcgggtcgtcgcgcaccgcggccggttcgccgctggcgatgacccggccgtgatgcagcacggtcagcctttgggcaaggccgaagaccacgcccatgtcatgttcggtgagcaggaaggcgaggccgtgggcacgccgggtttcgtcgatcagctcggccgccgctgtgcggtcgcccggcgacatgccggcggtcggctcgtcgagcatgatcagcttgggccgcagcgccaggctcatcgccagttccagccgcttcttgtcgccgtgggagagcagcttcgccgggtcgtcggcgcgcggtcccaaccccagcccgtcgagcagccggcggacctcggccagcgtgccatgccgcgggctgatccggaaagtgaggccgaagccgccccgggtccggcgctcgcgcgcctccaccgccacgatcaggttttcggccgtggtcatctcgccgaagatccgcgccacctggaaggaccggccgacgccgcgccgcacccgctgccagccggcaagcttcgtgacattgccgtcgtcgaagcggatctcgccgccatcgaccggaaactcgcctgagaccgccttgaacagcgtggtcttgccggcgccgttcgggccgatcaccacatgggcctcgcccggtgccacatcgatcgagacatcgtgcagcacctgggtcttgccgtagaacttcaccaggccgcgggccgccagcagcggcgcggcggagctgggggcggacaggctcatggcgtctgctcctgcgggcgggtggtcgatgcgacgggtctggcgggcgcggctgcggcgggccgcgcgcgcagtttcatcaccagccccatcacgccgccggggatggccagcaccacggccagcagcatcagcccggtggtgatgtcggcgatgccgtgcatggtgcgggtggcgtattccaccgcgccgaacaggatggcaccgatcgcagggccccagaagctggcggcgccgcccaacagggcatagagcaccggctttgtcgacatgctccaatgggcgagttcgggggtgacgatctgcatccagggcgcgctgaccgcgccggcgaaggcgctggcggcgcccgaaatggcgaaggcggccaggcggtggcggtcgacattaaggcccagaaaggccgcgcgcacgggatcctgccggatcgcccggaagctgcggcccagcacgccatgccccgcccaccagagcagggccgaggccaggccgcaggcgaccagcatgaaccagtaataggcatcgccctgcgtcagatcgatggtggcgacgccaagctcgatcgtcgggcgatagatgccggtcagcccgtcattgcggcccagccaatcggtcttggtgatcagcacatggaccagttcggcgaaggcgagcgtcagcacggcgaaatagatcccgcccgagcggcgcagcgccacgatgccgaagacgatcgccgccagcgcccccagcccggtcgagaggccgagccacatcaggaacggcccgccgccggcctgctgggggccggccgccatggcataggcgccgatggcgaagaacatcgcctggccgaaggacagcaggccgatggtgctgaacagcaggttccaggcctgggcaaacacgatgttgaccagcgtcagccccgccaggaacaccagcccctgattgagcagcgcgggcgccagggcgaagaggatcaggcccaccgccagcggccagagtgccagaagcggtgtcgtccgggtcgcaagcatcatcatgccacctgtgcgcgtcccatcagcccctgcggccggatcagcagcacggcggccagggcgacgaagaagaggatgccgggatagtccggcaggaagacggtgccgaagctttcgatcagccccagcatcacggcggcgatcgcagcgccacggatgctgcccatgccgccgacgatgatcaccccgaaggcctggagcaggaacacgccggccaggctgggcgacaggctctgattggcggcgagcagcccgccggcaaggcccgccaggccgaaggcgatcaccaccgtgatcatcagcacccggccgacgcgaatgcccagcagcttcgccatccagctgtccatggcgaccgcccagatcagcttgccgaaggtcgtccgctccatcagcaggtccagtccgatgaaggcgagcaggccgcaggccaccacgaacagcgcgaattcgggcatgatcgcatcgcccaggaacaccgcgccgcccagctcgtcgggcgtcggcaccgacatgaaattcagcccccagatcagcttgaccgcgccgtcgcagaccagcagcagggcgtaggtggcgatcagcacataggcgtcttcaaccccgcgcagccgccggaaaatggcgagatcggccagcacccccagcacggccaccgccatgcccgatgccagcgccaccaccagatacagccagagcggcacgccgccgccgcctgccagctgcagcagggtgaaggcgatataggcgccgatcatgaagaacccgccatgggcgaagttcaggatgtgcaggatgccgaagatcagcgtcagccccgccgccaccagaaaggtcgcggccgcccaggccatgccgttgaacaggatcagcgccagatcggcgaacgtcatcatcgcctccgtaaggccgcattggggtgcggaaggtcggggtgcgcaccgttggccatgcgatgcactctgtctcgcgaaaaaatgcagccaccggggagggggtgcggccggtcaccggggaggcgcgatcgtcttggccgcgccccggtggctgcaagtcgagagacggtcagagagacttcagttcaagcttctgtcccggccgtgccggttccaccacgctgtcacccggcaccgagacgaagtcggtgaccgcgaagccgtcggggttgttggccttggggctgatgcggatgatctcgacgctcttgatcgcctggttgtcctcggcgcgcagcgtgcgcttgccggtggcgctgtcgaaggtcaggcccttcagcgcggcgatgatcgcatcggccctggtctcgccgccggtcttctcaagtgccgccttgtaggcatagaccgccgcatgggcttccgccgcccagcccatcggatacttgttcccggtgcgcgcgacataggcatcgtagagatgcttcgacatcgggttgtcggtgttgccgttgaaataccagtgggtgccggtccaggtgtccggggtctggtccttcatcgccagcggcaccaggaactcgttggccgaatcgaccagcaccttggtcttttcgaacaggccgaagggcttcgcctgctggaacagggtcaccgcatcgccgccataggccgaggtatacagcccctcgaagggctggcgcaccgcggcggcgatgaagttcttgtagtcgcccgcgccatagggcaccaggatcggccgctggatctcgggctgtttgccggtgacctgggggaagacgttcagcatcgcatccacgaagatcgcccaggtggtgcggccatattcatgatcggggatgatgccgccccagctggtgacgttcgggtagcgctcggcgatcagccggatcaggccgtactggcgcgaataggggctgtcgcctacccggaagacattggggctgtaattctcgtggttcagcttttcggtgccggcgccgcaggtcagcaccgtgccgccggccgcctgcatcagcggacccatggccagcgccaccgccgaggagatggtacccagctgcaggttgacgccctggcccagcagctcgcgtgccgccaccgtcgcggcggccgggttggccttgctgtcgcggatctccagcgccagcggccggccgttcacgccgccatcggcattgatcttctcgaccgcgatttcggcgccatggcgcacgaagctgccgatcatttcctgtgcgcccgacagcggcgtcaccaggcccagcgtgagcgggttgtcggcggcacgggcgccggggatccacagccggctcatcggcgcgatcgcggccgcggcggcggtggtcttcagcagggtgcgccggctgaatttcgggcccttgaagctctgggtcatctctgtctcctccctgggcatggcgcggttctggttggtgtcccgtggggcacgggccgcgccttcatgcctcatccatgcgatgggtgcagatcgtgtcggtcgtgttcgggtgccccggcaagctgccggcgcagttcggtcttcaacaccttgcccagcgggttgcggggcagcgcatcggtgaggaagacccgtctcgggatctcgtaatcggccagcaccgccgtagcggccgcttgcagccgagcgatgaagtcttcatcggtttcgatgtcttcggttgtgtccggcgccgtgcgcaccaccaccgccgcgacatcctcgcccagccgcggatggggcagggcgatcaccgccgcctcgaacacgccggggatgcggtgcagcacgtcttccacccgccgggcggcgatcttcagcccgccgcggacgatcacatccttcaaccggtccaggtggtggagatggccgtcggcatctatccgcccccagtcgccggtgcggacccagccatccctgatcgtctccgccgtcgcctcgggcgcgtcgcgatagccgatcatattggccggactcaggatttcgatctcgccggcttcccccgccggcagttcgcggccgtccgcatcggtgatccgcacccggcagagcggcatgggccggccgaccgagccgggctttgccgtcacctcgtcggggagaagcatggtgccggtggggcccgtctcggtcatgccgtagttctggcgctgatcgacttccgggaaccgtcgggccagtgccagcaccgcctcctggggcatggcggccccgccgtaattccagagccggatgctcgacagatcgggggcgtctccgcccgcccgcgccagcgcatccagcagataaagaaagcccgagggcaccgacagcagcaccgtgctgcgccgggtcgcgatccgcgcaaggatgcgcgccgcatcgaaggcgggctccacgatcatcgccgccccggcccagagcgcggccagcgggttgaaatgcacgcccgaactggtgaagaacggcaccgcgtgatgatgccggtcatccggcgtcagccccagcgccgtgccgaagatcgcccccgtggccacggcagagcggtggctgtgctccaccgccttgggccggccggtggtgcccgaggtgaagatcagatcggcgacggcctcgggcgccacctcgggcagggcgagaccggcatcggcatccgccgtcagcccggcgagcccgtcgcccaggtcgatgcagcgggcagcaccgcccgcccgcgtgatcgcggcggcaagccgcggcatcagccccggttcggcaaaggcgagccgcagccggccaagcgcgatggtgtggtccagatcctcgtcgccatggcgggggttcagcggcaccagcacaccgccggccagcgccgcggcatactgcaccagatgggcctcggtgacggcggtgttgccggccagcacgccgatgccgtcacccggcccgacacccgccgccaccagcgcccgggccagccgctccgcctccgccgccatggcggcgaagctggtgacggccagcccgtccggctcggccggccgcagcagcgagggggcgatcagcatgggcgccgcgccatgttccgccgcccgcgcccgcagaagacggccgagcgtgcccgtctccgcaatcctgcgggcgagatcggcttcaagcggtccctggggcgtgggggcagccatggcggttccctctggtgagcttatcgaccggccagcttatcgacccgtgagcttatcgaccggtgaaggccggcttgcgcttctcgcggaaggcggcgaccgcctcgcgatggtcttcggtcaggttcgacatgctctcgtacccgatgcaggcatccatcatcgaatgggccagctgcttcagggcgatattggtcgcggtcttggtccagcggatcgccttggtggcgcccccggccaggcggtcggccagggcatagacctcgtcgtccagccgctccggcgcgaccgcgcgattgatcagcccgatctgcgccgcctcgggggcggtcagcaggtcgccggtcagcaggaattccttggcgcgggcaaagccgatcagctgcggccagatcaccgcgccgccatcgcccgccaccagccccaccgagacatgcgggtcgccgatcttggccttgtccgaggcgatgatgatgtcgcacatcagtgcgatggtcgcacccagcccggtggcatggccgttcagccggcagatcagcggcttttcaagatccagctggctgaacacgatgcgcttggcctcaagcccggtgcgctcgaattcgccgggcacatcgatatgttcctgcatccagttgatgtcgccgccggcgcagaaggcgcggccggcgccggtcagcaccaccacatcgctgtccgggtccatggcgaggtcggtgaacagccgcgagaattcctcgtgcagccgggcattgaccgcattcatcgcctcggggcgattgatggttgcggtcagcacgcggttgcggcgttcgaaggtgaagcactgatagtcgcggaattcgaaggcgccgggttcggtggtcacggggctggtttcctctcaggcggggcggttcgtctgccgcccttgggtgatgtcttcaaagtctctggcgatcaggcggcgttgctctgctcggcggtggcgatgaagcggtccagatgcaggtcgttaccgcccatgccggcggcgatcaccttcaggcgcttgaagccgtggccgacgatcatctcgtcggtcatgccgatgccgccatgcagctggatcgcctcgcggcccacatgcatcgcgagttcggccacatgcagccgggcggccgacactgcgcgggcgcgggcgagcacgtcgtcctcggccagcgcgaccgtcgccatgatcaccatcgaccgcgcctcttcgcaggcgatatggatatcggccatgcggtgctgcagtgcctggaagcggccgatttcctggccgaactggcggcgggtgcgcagatggtccagcgtcgccgccttcagccgctccatcacgcccaccgcttccgccagttccgcggtgatggcgcgatcgatcagcgcggccaggatggcatccgccgcgccggccagcagggccgccgccggcacctccgtgccctcgaacgcgatctcggccgcggtcatgccgtcgagtgtcggatagccggtgcgggtgatccccggcgccgtggcctccaccaggaacagcccggtggtgccgcccggcatgcttgccgaaaccagcaggcaatccgcctcggccccggcacggaccacgctcttggtgccgtccagccgccagccatcgcccaccggcaccgcccgggtgctgcgtggggcggccgggtcgcgcaggccgggctcgtcatgggcgaaggcgaccaccagccggccgccggcgatggccgccagccgcgcgtcgtcgtcggccgacccggtcagcatcagcgccgcgggggcgatgacggcggtggccagatatggttccaccatcagcccgcggccgatctcttccatcacgatcatggtctcgaccgcaccgccggcactgccgcccgcggcttcgggcagcgccacgccctgccagcccatttccgccatatcggcccaggcggcccggtcgaaaccgccggccgccgcggccttgcggcgcttcagatcatagcgctccgcgacccagcgcctggccatgtcgcgcagcatcgactgttcttcggtgaagcggaagttcatgtgatgctctttgtttggccctcgccgggcgggcactccgtgcccttggccgccgccgggtttttttagccccctcgccgggcgggcgctgccgcgcccttggccgccgcctcaatggcggctgggagcctgttgtgaacgcaggcagtgcccaggcttccgggcgttgcggtcagaggcccagggcgtgtttggccaggatgttgcgctggacttcgttggagccgccccagatggtgggggcgcggtggtagaggaattcggccaggatgccggcggcgccgtcgaggccgatttcgatgccctgcgcctctgcctccagcagccgcacatcgaaggggatgccgtagaggccgagcacgtcggtggcgagttcggtgatcgcctgcaccagttcgctgccgcggatcttgagcagggaggcctcggccccgggaccggccccctccatggcggcgtccagcatgcgcagcgtggtccattccagcgccagcacgcggatctccagccgggcgatgcggtcgcggaagcgggcatcatcggccagcacgccccggccgttggcatggggcaggcgggcggccatgcgccggatcttgccgatcagccgccttgccttgccggtttcggccgagagcatgcgctcatgccccagcaggaatttggcgtaggtccagccccggttctcctcgccgacccgctcgctcaccggcacgcggacatcgtcgaagaacacctcgttcaggtgatgggcgccatcgatcgagatgatcggccgcaccgtcacccccggctgcttcatgtccagcagcaggaacgagatcccctcctggggccgtgcggcatccgcatcggtgcgcgccaggcagaacatcatgtcggcccaatgggccatggtggtccagatcttggatccgttgacgatataatggtcgccatcgcgcaccgcccgggtcttcagcccggccagatccgacccggcacccggctcgctatagccctggcaccagaacacatccgacgacagaatgcccggcagatgccgttcctgctggtcggcattgccataggtgaagatcacggggcccacataattcaccccgaagggcagcagccagggggcaccggcgcgcgcggtctcttcctggaagatatagccttccaccggcgtccagtcgcacccgccccatttcttcggccagaaccccgcaatccagccctgttcatacaggatcttctgccagcggatgtgatccgcacgggaaagatgccgcccctccagcaccttcgcccggatatcctcgggcagccgctcctcgcagaaccgccgcacctgatcgcggaacgcccgctcttcggccgtgaactcggcgtgcatgcctcgctccgaactgattaatgattcataagtcattattcttgtcgctgaaaccggggcggggcgcaagatcaaatcgcgttgtgcagtacagaagaaattttaggaggggttgtgcggtgcggtgggaaaggtggcggggcggggcaggggacgaggggtgcctacttgcgtctgcggggttcggcggttgatcgcgtgggcagccttacaggtctacggctttgaactcttcgatcacgtcccgaacacgatgcggcggacaggatatgtagtccgactagatctcatcacagccatgaggatagcccaagaggttgctcatggatgctattacggcacagtagaattcgatatcgttcagactttgcttcggccatgcatcaagaaggatctttgcgacgtttctttcaacgccgatcagtgtctggaactcccaatccggaaagaagggcccttcgacggcggcgcgcaggcattctcctgcgatcttcatcgcttccgggctgattgcgcccaggtttaccatggggctgttggaccttcatgattgccagctggtggggatgtggagaagagcatcgctacgatgttggtgaagttcatccatggataggtttggtgcccaggttgggcggtttagcggcggaaatttcctcaccatgacgatagtcgcacaggggtgggcttatacatccccccgatctcatgtgttcttctgcgccgggagatgaatttaatgatgtggcacgcacctgttcacaaaagatcgtttggcctcggctactgatgcggacggctatctcgacttttggtcgcataaacctcgcggcgattgatcgctccgttgcgctcatgcctcttccataattcaggtcgtcggggctatgctagcggtgggtagctggtgtccacaagaggttctcaaagcaggtttctgcaaggttggggacagggcccaactcaaatatctaccttttcagtctcgaggcacccccttggcgggagaagaaggatatgaagataaagcatgtaaccattcataattttcggtcggttcaccatgcggactttgatctctacgactacacaatgcttgtaggggctaataactccggaaaatctaccattatcaacgctttaagaatattttatgaagatagcatcaaatggtcaaaagatgatctgcccaaaatagttggaccagatcgagaatcttggattgagttagaatttgaattaaatgatgatgaattcaggagtctacctgaaaaatatcaggggcattatcataatctaaaggtaaaaaaattcctagcatccgaagaaagtccggggcgggtaaaatctggacaaagtaatatatatgccatgctcccggatggctctcttgaagaaaatctattttttggggcaaagagtataagtcaagcaaagctcggtagggttatatatatacctgcactaagcactccctcagagaatttcaaaacaaccggagcttcgccatttcgtaatgttatttcttttttgctgaagaaggtcgttgaaaatagcaaaggttatgccgctttgggtacggcgtttgataccctcaattccgaagcaaagggcgaagctggatttctttcgcagctaattaatccgatgaatactgcattgagcaggtggggtgtgagtatgaaactggaagtaaagccagtcaccccggaggagatcgttaaaaatcaaatagcgcatgcttttcaagatgaaaactttgatggcgatctatctattgatagatttgggcatggatttcagcgctctgtgatatacgagctaattcgtctggctccaatatttgaggattcgaaaaaacgagacaagaaaattttcgatccggactttacactcctgctatttgaggagccagaagcgtttctccatcccaaccagcaagaaaatctggcgttaagcctacggaagctgggcggagaggcaaatcaacaggttctcattacaacacattctcctgtttttgtcggaaaggcggctaaggatctcaagcagattatcaggctgcaccgtcaagaaggcgtcagcagagtctttcagccttctgagcagaatcttgaggaacttctgtcgggagcgaatagactcaaagaagctcttgagaaatttgtaaatgatttaagtatagatgattcaagaaaggcaaaagcgaggaggctgatcgctagttttccagacagagaagtggcgatacaggaagatagtttccggttccaactttggcttgacggggaacgggcatctgccttcttttctgataaagttataatttgtgagggagctacagaaaaggcgcttcttaactatctgctagagaatgactgggaacaattcagaagtaacagtatctttattcttgatgcactgggtaaatataatttcccgcgctatcttttgctgtttgaaatttttggaataccacatggtgtcctcctagatggtgacgttaatagaaatgaacatgaggcaattaatcagctcattcactcgcttcgaggaacatatacgatcgacatacatcaatttgagaaggatttggaggcattcatcggcacagagaagccgcagtccggtcgtgatgacaaaaagccgattgaggtgcttaaggccatttctgaaaatagaatagatataatgaaaatatcggagctacagacaattttttccactatctgcggcataggaaataaagaaaacttactataagattattattttgtccaaggacaatcacgcccgtccatgctcagcatgtaatcgtagagttaaaatggcgagatccacatcttccttcgttgggcgaaatgtatgttcgttcataagatgatagtggagttcattctgcggatgatcaagccgctgctcttatttggcggtctaaatgaagatgtcgtcatgatgatgcaatcgatgagattaatgacgcatgctcgtttctgccatcaccaacctcacacgtcgcccaaaccatcctcataatcccgcgccccatggatcacatgaacgatcaacactcggtcctcttccacccgatacagaataagatagtcgcgccaggggcggcgtcgcaggccgaggtgttgatagcggggcagggtggggtaagcgtggggtgtgtcgccgaggcggcgggccacgtcgcgaagttcgcggataaagcttgccgcgcgccgcggattgtcccgggcgatgtgatcacccaccgcccgcaggtcagcctttgcctcgctggaaaactcgaccctcacgactccgcgcgcgcgtcggccatcgccatatagcgggcttcgagttcgtcgaagacgtcttcggcagggtgggtgcggccagccgcgccgtcggccaggccgcgcatgacggcggcgtcgagggcggccaggcgccgttcgcgttcctccatcaggcggagggcgtcgcgtatcacctcgctggcgttgttgtaccggccgctggcgagctgggcctgaatgaaggtctcgaagtgcttgccgagggtgtagctgccgggcatcgccattctcctcacctctatcgttgaatgatagtgtcggcgctgatggcgtgcaatgtcccgtggcaggccgggatggacagcttcgccggcccgatgcaccatctggctgacgcgtccatgcgggagacctcaatgccccgaccgtcagattctccggatccggcaccgcccgggccatccgactgccccgaggaatcaatcccggccaccgccacgccggatgtgtcggcagtcatcgatcccagggtctgtttacgcgccgccatcgcccgcggcgtgagcgacgacttcatgatcgacggccgcgaacagcccgatctcccgccctccgatctctcgcactttgatttctgaccccccaaaaaaaacagccgcacccccaaggatgcggccgttctcaccccgtcgccccgcccttgtccgggcaggccgcaggtcagctcttcttcagcgccgccgaggcgttgccgatttcgaaggtgccctgggcggtgccgctttccggcacgatttcgcgggcgcggtcgccgatctcgtcgatgcgggcggcgatctgttcggcggcgtcggggccgtcgccgatatagacgccttcggtcagcgtcacataagcgcgttcaaagctgccggcgccggcgttcaggatcatgcgggtcggcgcgtcttccgacaccaggtagagcaggccgggggagaccgtttccgggcgcagcgccgccagaacctcggcggtcatcaggccttcggtcatgcgggtcgcggcggtgggggccaggcagttgacgcggatgtcgttcttcacgccttccagcgacagggtctgcatcagcccgaccagcgccatcttggcggcgccgtaattggactggccgaaattgccgtacaggcccgacgacgaggtggtcatcaccacgcggccgtaattctgcgcgcgcatgatctcccacaccgccttggtgcagatcaccgcacccatcaggtgcacgtcgaccaccaggcggaaatcgtccaggctcatcttcgcgaagctcttgtcgcgcagaatgccggcattgttgaccagaatgtcgacccggccccagcgcgccatggtctcggcgaccatcgcctcaaccgccgccgcatcggtcaccgaggcgccgctcgccatggcctcgccgccggcggcctcgatctcggccacgacctgggcggccgcatccgaagaccgcccgtcggcgcccagatcgttcaccaccaccttcgcaccgcgcgcggccagcgccagcgcatgacagcggcccaggccgccgccggccccggtaacgatcgcaacgcggccgtcgaacctcatgctcatgaactccaccttccctgtcggtcatcttccgctccgcaggtccggccacgctcttggcatatgttcccgggcaaacagccctccgggcatatgggggcatgatcggcggacccgccgcccgcagcgcgtctgccgcgggccggcgcgatcatagcggctgcgcgccgcagcgcaaaatatacggtgtttgaaagatcttatggccggccataggcgccggacccgccggcctcggccgaggcctcccgcgctgcggcgaagatcagggcgcggtcggcctcgggcagttcgctgccgctggtcgtggtcaccacgcaggccacctcgtgctgggcatcgaaaaccggcgccgcctggccggtgatccctgagagcagatggccgctgagttcatggccgaagctttcgcggatccgcgccagatcgcgggcagccggcggcttgccgcgaaacggtgccggctggagtttgcgcgcgacctcgatccgctccggcggcaggaaagcctgaaagaccaggccgcaggcggtgttgtccagcggcagcacatcgcccaggccaatggcgctgatcgagaaataggcgctgcgataccagcgcaccacggtggggccgcgatcggtccagatcgccaccccgccgctggcggcgatgcgcatggccagcgccttcatatgccgcgccgccacctccaccgcatcgatccggcgcagcgcgccgatgccgatatccagcgccgtgggccccagatcatagcggccgctggcggcttcctgcaccgccagcccttccttgatcaggctttgcatatagcgatgggcggtggaggtgccggtgccggcgcgccgggccagatcactcagcgccatcggcccctcggcatcggccaggatggtgagaaagcgcgccgcgatcgagaccgactggatggtaccggatcgccgctccacacccttgtcgtcctccatctccaccccgctcatcgaagcaccgagggcagccagagggaaataccggggaaagcgagcaacagaaccatgacgaccatttcggcgagaagaaaccacgcggcgccgcgcaccacgcggccgaaggagatgccggccggcatcagaccatgggccgcaaacaagttcaatccgagcggcggcgtgatcaagccgatctcgatatacttcaccgcgatcaccccgaaccagaccatgtcgagcccgcgtgcctccaccgccggcaggaagatcggcagcgccagcagcatcacccccatcgggtccagcaccgtgcccagtgccagcagcaccaccgacagcaccagcaggaaggcgatatcggtgtcggcgaaggccgccagatggccggcgacgaattccgggaagccggtcagcgccagataggtggacaacgtgctcgcccccaccgccacgatcaggatcgcggccgtggtccgggcggtgtcggcaatggcggcccgaaaacccgcgcggtcgagcgagcggcggatcagcgccacgatcagcgccgccaacgcccccagcccgcccgcttcggtcggcgtcgcgaagccgccataaagcccggcgatcaccatggcagcgatcgctgccaccggccagacgcccagaacctcgcgccagccgggccgggggccgtcatccgcgccgccggcgctgccggcgatggcggggttcagccgcgcgcgcaggatgatcatcaccgaataggcaagggcggtcagcagccccggcaccaggccggcggcgaacatggtcagcaccgattgttcggtcaggatcgcgaagatgatgaaggggatcgacggcgggatcaccgcggcgatggtgccggcacagccgcagaccccggcgatcagccccggatcgtagccgcgtttcagcatctgtggcacggcgatgcggccgacccccactgtggccgcgaggctcgaccccgatgccgtgccgaaagccgcgcaggtgatgttggtggcaaccgccagcccgcccggcacccgccgcgtcaggtgctggaacagcgcgaacagcacatcggccagcccggcgcgggcgacgatattgcccatcagcaggaacatcggcacggccgacagctcccagctggcggcgaattcgagcggcgcgcgcgacagcagggcaaagcccggcccgatgccgatcatcgccaccgtccccgccagccccgccgtgaacagggcgaaggcgatcggcacccgcagggccgccagccccaggaacagcagcagggccaggcaggcctggtattcgggggacagggtctcaggcgccatggggggcctccaccggcgggcggccggctgcggtgcggatcagctgaaccagggccaccagcgcgagcgcgccgaaacccgccaccaccgcccagcgccccggccagaccggcagggaaaagccggtcaggaccacccgctcgccgcgcagcgtcgccacccaggcgacatcgaaggacagccaggtgaacagccccgccaccgccaccgtcaccagggcggcggccagccgctgcaggtaaagcgcccggccgcccagccgttcggccagcaccgccacctcgatctgccggccggtggcctgaagccccgcgagcggcaggaagaccgccatcaccatatagatccgggccaccgcctcgggcatgccttcgggtgtgccgccgccgatcaggcggatgatcagatccagcgccatatgggcgaacatggcgagcaccgccagttcgcccagcgcaccggtggccgcggccgcaagcgccgccacccggtcgaggatgcgcatcagccggggcacgctgccaggctttccgggaagacggtctcggtcagcagccgggtcatctcggccgggtcggccttgatcttcggcaggtagtcctcgtgccatttgcggtagatcccggcgatccgctctgcgaaggcgtcgggttccgcgatgccgcgcgcggccgcacgggccgccagcgccttgatctcgcccgcctgataggcgggccaggccgcctgcatcgccgcgtcgccgcccgagaaggtcgcaaccgcttcaagcttcgggcgcaccatggcatcggcgtcgatataggccttctgcacatagggcagggcggatgcggcggcatgggccaggatcgccttgcggtcggcctcgccgatccggcaccaggcgtccaggctgaccgagaccggcaccgcgccaccgacgatgccctggggcatgtcgatcacgcccctgacgacatcggtcaggccataactctgcgcccagctgagcggcaccagcgcgcaatcggtcttggccgtctgcagcgagatcagcagatcggtgatcgaggtggtgaccgggatcatgcccagcgcctcggcccagcgcgcctcggggctgccgatcacgctgacccggcggccctgaagatcggccttgcccgcaaccgggctggtgcactgcatcgccatcggtgcggtcgcattcaggaacagcgggatctggccctcgcggcgcatctcgtccaggcagtcggggcagccctgaaaaaaggcttcgttgatcgcgcccatcgccgccaccgggtcgacgccgaaaccggtcagttccgacatcaccgaggcatggggcaggtcggacgggtagaaggccagtaccacgaagcccgcattcaccacgccgtcgcggatcgaggacagcaccgtcggcatcttcaccaccgtgccgccgaacaggccgcggaatgtgacccggccttcggtcacggtctcgatgcccttcaggaagggcaccacgccctcgcgattgaacagcgcctgttccggcaccggcgacccataggtcagcgtcgccgcctccgccgccgtgccggcggtcgccgccaggcagatcgccgccgcggcaagcccgcggcgcagtgtcgtcaatctggtcatgggtcctgtcccccggtctgtcgtctcccgctccgcgaccggccttgctgtcctgtatcgcggaatatattctggatcgtggaacacgctccgccatctgtcaaggacgcccgcatatgcgtaaggaattgatcggtctcgatcatctgatgatttcaaccccggatctgccggcgatccgcgcctgctatcagcggctgggtttctcggtgacgccctggcggaccaacgagccgatgggcggcggcagaaccggcggccgcggcggcaaccatctggtgctgttccgccccaccgatgaccgcatgaccaatttcctggaattcgcctatgccgacccggcccatgccgtgccctatatgcgcgacctgctgggccgcaggccggcgctggcgatgatcgtccacgccgcgaccgatctccgcgccctggatgcgggctggcaggcggcaggctttccgccctgcatgtattacgaactcgacaccgactatcgcgaccccgaggacggcacggtcgaccggatccatttccgggtgctggtgcccgatgcgccgcgcggcccgctcgccttcaatgcctgcgaggtgatggaccgcagccattatctgcgcccggcctggatcacccatccgaacagcgccgaatactgggcggcggcgacggtggtgaccgatgatccggcggcgatgcgcaatcatctggcagcgatttacggcatcgatccggccgggcaggggccggtctcggtgaccctgggcgatcagaccctgacggcgatcgatgccgcaggcttcgccgccgcctggggcgatgccgcgcgtcgcgccgatggcagcgccgccgaactggcagtagaggtgcgcatcgcctcggccgataccgcccgcgcggtgcttgcccgcaatggcgtgcgcttccgggacgagggcagccggctggtcgtgcccgcggccgaagccggcggcatcgtgctggtgctggccgaggccgcctgagccatgcgcgccccccaaacccacgaaaccctccccatggctggcgccatcggcctgatcggcggcaccggctggccctccaccgcgctttattacgagcgtctgaaccgtctggcagagccgggcaccgtgccggtgctgatcgccagcctgtccttcgcgcccgtcctggccgatgccgaacgcggccgcttcgatctggtcaccgccgccttcgtggcggcggggcaggggcttgccgcggccggggccggtgtgatcggcctttgtgccgccaccgcgcatctggccttcgatgcggtcgccgctgccgtgcccgtgccctgcctgcacatcgcagagcccttccggcacccggccggtctcttgcccaacggtctcttgtccaaaggggccgcggtcggcgtgctcggcacggcacagacccttgaagcgggtgtatttacgggccccctcgccgcggccggccacagggtggtgacacccggtgccgggctggcggcggggctcgaccgggcgatcaagaccggcatttcctccgggcgtccgaccccggcggatatcgccgcggttcaggccgccctcgacgatctggttgcgggtggggccgatgccgtcgtgctcggctgcaccgaattgccgctgatccgcgaccggctgcggccggccgtgccgctgatcgatgcggtggcggcccattgtcaggccctgctgtcgtggtcgcgcggctgagtgctgccgcctgtgccaaaaaaaaccgcgccgcgggagacaagaacccggcaggcgcggtgaaggatcgcacagggaaagtgcgggcaaggagacgaccatgacgagccgaaggtccgatgacccggtccgtcccgatgtccagatcacattaccgctgcactgcttaacgaggcgtgaactcccgcaggattttcgcgggccccgacagaaatctgcatgatgtgtcgcagatcggcgctccgcgacgtgcaacgggtctgtgtccttttcggggcgcgcgtcagggtcttgcgggttcttcttgcctgtctttcgcgtgcaacagcaggtcccggggggtgatatccctcccgcgggtgaaaaacattgccggaagatgtccaccgggtgtcagcgccggggccttggcgggccccggctgccggcctccgatccgtggccagggtgaccacaaaacgccacctggaccttcgcccccatcaacccatatcatttcaacgacgcggcgcacggaacagacaccgcagccgccggagtgtcatcggtcaacacagccgacgggggatgcatcatgtcgcatgtcaccgcaagtatcggaaatcttccctacgccgtctcgatttcgaccggaaaccatcgcctggcgtccgacgagcccgtggtcatgggcgggggcgatcatggccccacaccacacgatcttctgttgtcgagccttgcatcctgcacgctgatcacgctcaaaatgtatgcgcatcacaagcactggccgctgctggcgctcgacgtggagttgagcttcatccgcgatgaagccgcagaagatgcagtgacggtggagcgggtgatcacgctgcacgggccgctttccgatgccgcccgcgacgaactcgccgatctggccgaacgcacgccggtcacgcttcgtctgaagccgggtctgccgatcaacaccatcttccgtcaggcggcggtgccggtgatggcggaggcctgagcgagcctccgtcatccttcgcggccggcggcctcaggccgccgccaccgccctcaggaagccgtccaccgtgccgcgcagccgggtggagcgttccgcaagcgtgcgcgccgtgctcaacacctgcgccgagcccgacgcggtggcttccgccgcgatggtcaccccgccgatcgtgtcggtcacgtcctgggtgccgcgggcggcctggtcggcatttcggccgatttcggcggtcgcggccgactgctgctgcaccgcggcggacacggcactcgacatgccctgcacccggtgcaccacttcggccatccggcccacggcatccagcgccgcgccgatgctgccatgcatatgctccacccgtccgcggatgtcgccggtggcccgtgcggtctgggtcgccaggcccttcacttccgatgccaccacggcaaagcccttgccagcctctccggcgcgcgccgcctcgatggttgcgttcagcgccagcagattggtgtggttggcgatctcttcgatcagcgcaatcaccgcggcgatatcgttgccggcgcggtccagctcgccacccagcaccttcacgcgctcgacctcgtcgctggcatcgcttgcaacgccacgggcggtctccatctgccgggccacttccgaaacggtcgcggtcagctcttcggtcgccgccgccactgcctgaacattggccgaggcctgcccggccgaactgcccacggtcgaggcctggcgcgaggtctcttccgagcttgacgacagcagctgggcggtcgcttccagctccacggccgaactgctcatcaccgccagcatctcggccacttcatggtcgaaatcgcggatcagctgtgccacctcggcggcgcggcgctcgcgggccgtcacctgagcggcttccgcttccagcagccggcggcgttcctgcgcattgttgcggaagaccagcatggcgcgggccacgtcgccgatttcgtcgcggcgatcggtgccctgaacctcggcatccagatcgtcggccgccagcccgttcagccgccgcacggtgcgctgcaaggggcgcgcgatggtggcgatggcgatcagcaagccggcgatcaggccggccagggtaccgacgatcgcggtgaccacgatttccatttcggtctcgtggcccagcatgcgggcatcttcggcaaccgcatgcgcccgggcctcgatatcctcgaccagatgcgccacctcgtcagacagggcgtgggtggtggcacgaccccgctccacctcctccaccacggcccgctgggcggcgtcgatctcgcggccctcgtggcggcgcgccacctccagggcgtgatggacctcgccgacataagtctcgaaatgctgttcgatcagcgcaatgcgcggcaggtcgcctgcttcggcatgatgggtcatatcctccagcaactcgcggaagcgcagcacgctctcctcgatctcggcggttgctgcgggcaattcgcgcggatcggccgccagccggtattcggcgtggcggatatcgctgatcgccttggtcgccagcgtgccgtccagcacctccatcccggcctcttcaacccgggtggtggcatcgatgcacaccaccaggccgcgataagacaccaccgatatcgccgcggtcaccgccgacatcaggataacgatcgatgccaccttgtgggtcatcttcaggttggagacaaatctgttcagcatggcaggcgccgccgtctttttgtgggaagctgacggcagtatccctgtttccctttaaacaaatgtaaaaagcgccgtgcgaaatatttgcggcaccccgctccttataccaatcatcatggatgatacatggccagtacagcctgttcagccgcgaatcagtcgcatgatcacccggtcgagggtctgcagaaaattggaccggtcgcgctgggtcatcggcttcgggcccttcagcccgccctgatcggcgccggcgcgcagatcggccatcagcgcccgcatcgccagcgcctggccgatattggcccggctgaattctcggccatcgggggcgatcacggccgccccggcttccaggcagcgggcggcgagctggatgtcggcggtgatcaccacatcgccgggcgtgacatcggcgacgatccggtcatccgcggcatcgaagccgtcgccgacggtcaccagctcaaccctcgggtcctgcggcacgttcagccaggcattggccaccacgcgcaccttcagcgacaggcgctgcgccaccttgtaggtttcggccttcaccgggcaggcatcggcatcgatatggatcacgggtggggtcatggggcggcagtctgccctgatccggcctcggatgccagcgccgcggcgcgggccagcagccgtttcgcattgccatagcggggcagctccacctcgatcccgtccagcatcacgcgggcggcaccctcagcccgtgccgcctcgaaggccgcaaccagccgctcggcctcagccacctcgtgcacggccggggtcagcgcggcattgatcaccgccgcatgggcggggtcgaccaggcttttggcgacatagcccagccgccttgcgcgcaatgcatccgccccggcgcctgcgtcatcgcgccaggtataggggcagtcgacggcgatcacgcccgccgccacgcaatcgaccagaaaccggccgcgggcatggtccagctcggccgcatcgggcccgcgtatggcccccagatcggcggcgaggtcttccgatgccatcaggcagccggcgacgcgcgggctggcggtcgcgatctcgaaggtcaggcgcagcgcgcgggcactttcgatattgggtagcaaagcggtggaacccggcggaatgtcatatgccgcttccagcgccgccaccgcatcggcaagccggatcacgtcctcagggccgctcaccttgggcagggccacgatctcaggccggccgcgcatcacggccttgaggtcggccatgccgtcgccatcgagcggattgaccctgaccgccacccgcttgcccgccgcccgccagcgctcataggccgcaggcgccagcgcccgagcctcggggcggcgggcagggggcgtgaaatcctccagctcgtggatcagcagatcggcggggcaggccgccgcgtccgcgatcgcggcctccgaggcgccttccacgaacagccagctgcggcagaggcggaagcggtcgggcgccgaagtcgtgtcggcggcagcgctcatccccgcacccgctcggtcgcctcgaactggcgggcggcatccagcagcaccggcagatattcgccctccagcatctccacgctcacccgcgccgcctgggcgctgacattcatcgccgccaccaccacgccggtgcggtcatgcagcggcaccgcgatcgaccgcagccccagctccagttcctgatcggcgatggcatagccctggtcgcggaccagggccagccggtcgcccaggcttttcatgtcgcccaggctgtggggggtgcggggctcgaaagaaatgtcgcgcagcaacatattgcgccgggccggcggcaggttggccagcagcacctggcccatcgaggtgcaccaggccggcagccttgcccccacattcaggctgatcgccaggatccggtgccgggcggcggcgcgggccacatagatgatgtcgatcccgtccagcacggcggcagagcagctttcgcccagcgtgtcgctcacccggcgcagccagggctggatcgcctcggtcatgtccagcgacgacaggtaggaaaagcccagctccagcaccatgggcgtcagctcgaaatacttgccgtcgctgcgggcatagcccagcgcctccagcgtcagcaggaagcggcgggcggccgcacgggtcagccccgtgcgctccgccacctcgctcaacgtctggcgtggcgcctcggcgccgaaggcgcgcacgacactcaggccgcgggcgaaggatgcgacgaaatcaggcgaatccgggtcgatcatcggccgctccgcgacagcatgggtgccgttcgtggggtgaacgtcccccatgctaggcgaacgaagcccatccgtccatccacgcatccgtgtcgtcttgtggccacatggaaaaagccaggtatcgcattgaacctgcgcggcggatggtctatctggggaagggcgtgtcgggaccacaccagaggtcattcccccggggacgggcggggaatgcacctgtcgtgcaggagcccgtgccgtgccccagaccggcgccctcgatcagaccagtccctccgatcagaccaattccgtcgatcagaccaataccctgggcccgaacgaccacatccagtcgctgaccccgcttcggggcatcgcggcgctctgggtggtggtctatcatttcagcttccagtatctccccaatatccgccccgaggcgctgaccgaggcgatcggcaaggggtatctggccgtcgatctcttcttcatgctcagcggcttcgtcatcacccatgtctatcaccgcagcttcaccgccgatccgcccggccggtaccgggatttcgtcaaggcgcggatcgcccggctgtacccgctgcatctggcagtgctggggttgttcgtcgcaaccacgctcggcgcccgggcgatggattatgccctcaccgggcatttcgagatgatcccggtcgacggcgcgcggtcgatcagcgcgctggtcgccaacctgttcatgcttcaggggctgaaggcgtcggaactcagctggaactatcctgcctggtcgatcagcctggaattcatcgcctatctgatcttcccgatgctgttgccgcggatctgggcggcgccgcgcggggcgaagctcgcgctggccggcctgctctatgcggcgctggcctggttcgcctgggataccggcgacgacttcaatcagtggaacgggccgcagaccctgctgcgctgcctgccggaattcctgctcggcagcctgctttatgccgcctttcgccatggtggcgccggtcggctgctgggaggcgacgccgccggccttttcctgctcggcctgacgctcgtctgcctgcatctgggggcgccggatctcgtgaccgtcaccctgttcgccgggctgatcctggcgctggtcgccaatcgggggctggtcgcgcgcgcgctcaacatccggccgctcgactggctgggccgggtgtcctatgcgctctatctgatccacggcttcgtgcaatacgccgccacccggatcatcaccgatctgaccggggcggggcgagaggcgctgtcgccggggtggtcgctggtcaccttcgcgatcatgaccgcggtgagcctggcccttgcccacccggcccatcaccggatcgagatcaccggccggcggggtctgcgccggctgctcggcatcgaccggcagccggcggcggcgtagcaggccggccgtcagaggggatcgaccggcagggtcgggccgacccgcgcctcgatcgcggcgccggcatccagcatggtcgcttcttcatagcggccgccgacgatctgcacgcccagcggcacccggccggtgccgtcgggcgacggcatgaagcccaccggcaccgacagccccggcaggcccaggatggcggtggcgttcagcggcgcgaaggcgtcgatcagcggtcgaagttccgccgcgggtttgcggtcggcctcgcggtccatggctggttccagtgccaccggcatcaggatcaggggcgtgtgctcgaaaaaggccagccagttgcgcaggatggcgttgcggcgggcaaggccggcgatgaagccggtcaggtccagttcccgcccggccagcgccatggcgtcgaccatgttgttcagcaccgcatcgccataggtccgggcggtttcgcgggtgccgaacaggttctcggtggacaaaaggtcgagccagagctggtgggcttcggcgaaattgggcgggctcgcctccatgacctcatagccggcctcactcagccaggtggcggccaggcgcagcgcgtccgccaccggcggcgtggtgccctcgggcacgaacagggcgacccggatcggcgccgcatgccgccgcggccgttccggaaccggcacccaccaggggtcgcgcgggtcgcgtgccgccatggcgcccaggcccagccgcagatcccggatgctgcgcgccagcggcccctgcaccgcggccagattggagacgatcatccgctccaccccaagcgacggattgaacgccgccacccggcccagcgtcggccggatgccggtgaccccgcagcagaaggccggcagccgcaccgatccccccagatcattgccatgggcgagcggcccgatgccggccgccagcgccgccgccgccccgccgctggacccgccggcgctgcggccgggggcgtgggggttcagcgtcgccccgtgcagcgggttgtcggtgaaccagcgcatcgacaggctgggcgcattggtccggccgaagggcacggcgccggccagtttccagttgcgggaaaccggtgcatcctcggcggcgatattgccggccagcgccggcaggccgttggtggtggcggatcccgccaggtcgatattgatcttgatcgtcaccggcacgccgtgcagcggcccgggctcttccccggcagccagtgccgcatcggcgcggtcggcggcggcgaaggcgctttcgtccagccgaatcaccacggcgttgatccggccgttcacggcgtccatccgctcgaaacaggcggtcagcgcctcgcgtgccgaaatcgcccggctgcggatgccggtcgcgatctcggtcgcatcccactgccagagcggggtggtcggcagtgctgtctcggtcgtcatgaaagaccctccggcggttgggggagagatgcgtgggaagatgcgtgggtgggggctcaccgtcccgacagcgtcatgccgccgggggcgctcgtcccctcgctttcgaaggcgcggagcatggcggccatggcatgggccccggggtcgtcgctggcatcgagcgccccgatcaccccggcgcggtcggcggcggtcttgtcctggttcagcttgaacttggcctcgacgcggtcgagcggcatgtcgatcgccacgatccgttccagcctgggcaggatcagctcgtcgggcatggccgcgaaggaccaggggccgccgagaggcgtgtcccagagggcgacggtgcggcggagcacggccaggatctcttccggctcctccaccaggcgtggccggccgatgccgtggatggcggcgtaattccaggtcgggaaggtcatccggtcttcgtaccaggacggtgagatgaaggcgtgcggcccctggaagatcgcaagggccggggtttccccgccaatgaaatggcgccattgctcgttgttgcgcgccatatgggtcacgagccgcggcggcgcatccgggcgttcgtcgaccagcatcggcagatgggtggcgaccggcccgtcggcaccggtcgagaccagggtcgcgaagctccaggcccgcatcgcctggtggatgatccggggccgctcttccagataggcggcgggggtgtacatcggcgctgcctccctcagttcaggcgaagggtatgtttcagccagagcgccgtgtcgtccagcgcctcgccggcgactttcgccaccgataccgcctcaaggaagctgtgcaccgtgccgggatagactttcgccccgaccggaaccccggccgcggccagacggtcgcgcatctccaggttctcgtcgtaaagcgggtcgcattcggtgatcaccatccaggccggcggcaggccggtcaggtcggcatccagcacgcgcagccgcgggtcgaagcgctgctcggggtcggcgacgtaattcatcaggaaccagagcatcatatgggtggtcagcagatagttgccgccgccccagcgcagcaccgacgggctgaccagatccatcgagaagccgccgtaattcagcaccatggcggcgatgggcgcctcgccggcatcgcggaaggtcaggcaggccgagacggtgaggttgccgccggccgaatcgccgccaagcgcgatccgggccggatcgaggccgaattcggcggcgcgggcatggatggcgcgcacgacatccaccacctcctgcggcgcctgcgggaagcgggcttccggcgccagggaatagtcgatgccgatcaccaccatccgggcgcgggcggcatattcgcgcatcagccggtcatgggtgtccaggctgaacagcacgaaaccgccgccatggatatagatcagcgccggtgccggcgccgccagcccttcggggcgatggaaacggatccggaccgggccgtggcgggtcgggatcatatggtcctcgcgggaggccatcaccggcccgccctcggtccagggctggcggacgatttccgccacccgccgcgcctcgggcggggtcagctgttcgcggggcgggtgggccgaggcgtcggcgatcatccggcggacgaagatcgcgatctcggggtcgagcacatcgtatggagaggcggtcatgagcgtacctgtcaagcgggggcgggcgcgtccgatgccgccccgtgacgggcggcgaagatggcgcggccaggaatggcggccagaagatcgcgggtatagtcgtgggcggggtttgcgaagagtgctgcggtcgggccctgttcgacgatgcggccatggcgcatcacgatggtgtggtccgacacctcggcggcgacgcggaggtcgtgggtgatgaagatcatggcgaggccaagctcgcgcttcagatcggcgagcagggccaggatctgcgcctgcaccgagacatcgagcgccgagaccgcctcgtcggcgaccaggatggcggggcccggcgccagcgcccgggcgatgcagatccgctggcgctggccgcccgagaattcatgcgggtagcgcgccgccgccgaggcatcgagcccgacccgttccagcagccgggcggcgatcgccagcgcctcggccctgggcgtgccgaaggcgatcgggccgcgggcgatggcatcgcccaccctgtggcgcggattgagcgaggcgaaggggtcctggaacaccatctgcacccggcggcgatagctcttgagcgccgccccgccgagcccggcgacattctgcccctcgaacaggatctcgccgccatcggggcgggtcagcgccatcaccatccgggccagcgtcgatttgcccgacccgctttcgcccaccaccgccaggctttcgccggcccgcagcgccaccgtgacatcgtcggtggcatgcaccacccgccggctgcggaagccggtgcggctggtgtactgcttccgaagattgtggagttccagaataacaggggttttggttgtggcatcggctgcgggcttcggcccggcgcggccgggtaccgcctcgatcaggctttgggtataggcatgggagggccgggccagcaccgtgcggccggggcctgcctccacaaccttgccatggcgcatcaccaccacccggtcggcgatgtcggcgacgacgccgaaatcatgggtgatgaacagcacccccatgccccgcgccttctgctgggcgcggatcagatccaggatctggcgctgggtggtgacgtcgagtgcggtggtcggctcgtccgcgaccagcagcgccggatcattggccagcgccatggcgatcatcacccgctggcgctggccgcccgacagctgaaaggggaagcgccggccgatggtctcggggtcgggcaggccgaccccggcgaacagctccaccacccggctgcggcggccctcgcggtcgagacggccatggatcgccatggcctccgctacctgatcgccgacccgggtcaacgggttgagcgcgctcaacggctcctggaagatcatcccgatatcggcaccgcggatccggcgcagcgccgcctcgtccaggctggcgatatcggtgtcgcggaagcggatctcgccgccggccagccgcacccgcggcggcagcaggcccagcaccgcatgggcggtcatcgacttgcccgaaccgctttcgcccaccaggcagacgatttcgtcggccgcgaccgacagccagaccccgtcgacggcccgggcccggtcgccgccccggggcagggcgatggaaagatcgcggatgtcgagaagggaggtccctgtcaccgtcaatgtcctcctgcggttccgcgggcgcgggagatgcgcgggttcagcgcgtcgttcagcgcctcgcccaccaggttgaccgccaccaccgtcagcaggatggcgaggccgggaaagacgctggtccaccaggcctggcggatcacggtgcgggcggaaccgaccatgaacccccaggacatgtcgttgggatcgcccagccccaggaaggacagcgcgctttcgatcaggatcgccgtcgccaccgtcagcgaggtcgcaaccacgatcggcgaggcggcattgggcaggatgtggcggatgatgatggccagtgcgctttccccctggcagcgggcggcatggacgaaatcgcgggtggcgatgctcatgaactcggcacgggtcagccgggcgagcggcggccagctgacgaccgcgatcgagaagatcaccgtctccatgccgggcgagaggatcgcgaccagcaggatggcgagcacgaagcccgggatggtctggaacagttcggtgatccgcatcagcacgtcgtcgaccagcccgccgaaatagccggcggccgcacccacgatcaccccgatgccggcggccgagacggcggaggcgatgccgatgatcagcgacacccgggccccccaggcgatgccggcggcaacgtcgcggcccagcgtgtccgagccgaagatcagcccctcggacaggggcggctcgaagggcgcaccgaccatctcccagggatcgaccggaaacagcagcggcgcgccgagggcgagccccgtcaccagcgccagcagcaccgcgccggtgatcccgctcgggtgacggaagaaggcggagaagaaggcccgcatgggtctgcaaatcctctctctggcaggagggcgctccggcggcgccgtcacccggcccgggccaggcgcggatcgatgatccgggtgatcagatcggtcagcaggttgatcgcgatcaccagcaccgacatcaccaggaagatcccgagcagcaccggatagtcgcgctgcatcaccgcatcgaaggtgagccggccgaggccgggccaggcgaagacggtttccaccaccaccgagccgccgatcagcgcgccggcctggacaccggcgaaggtgatcaccggcagcagggcgttgcgcagcatgtggtggcggatgatccggccgcgcgacgcccccttggcccgggcggtcttcacgtaatcctggtgctccacctcgatgatcgaggcccgcatcagccgggcgtagatcgcaagatagatggcggcgagcgtggtcaccggcaggatcatgtgggtggcgacgtccagcaccagatcgatgccggtgaggctggggccgatggtcgcgaagccgaaggccggcagccagcccagctgaaccgagaagatcagcaccagcatcagccccagccagaagaccggcatggcatagaacagcagcgccaggaccgagatcaccgtgtcggtccagcggccggcacgcatgccggccagcgtgccgagcaggctgccgatggccagcgccagcaggaaggcggtcaccgtcagcagcagggtggcgggcaggcgctcgccgatcagcaccgaaaccggctgacgctggcggtaggaatagccgaggtcgaaactcgcgaccttggccagatagtcggtcagctggacatgaagcggctggtccagcccgtattcggcccggatctgggcgatcagcttttcgtcggatgcgcccgactggccggcgatcacggccgccgggtcgccgggggcggcatggaccagcaggaagttgaaggtcgcgatgatcaggatcatcaccgcgatcttcaccagccgggccgccgccgccgcgatggcctggtacatgctcagccctcgaaccaggcctgatcgaagtcgtcattcacgccgatggccgagaccaccagatcatggaagcgcttgtcgtacatggtcgggaagtcgagttcgaccagccagccgaccggcacctcttcgaccagcaggcgctggacttcggaatagagtgcctggcgcttcgccgggtcgaccgcgaccgccgcttcggcgaacagttcgtcgaccttgggattgctgtagcccgaggtgttggagaacagcacgcccttgcggatgttcgacgagacataggtccgcgacacgccgagcgccgggtcgccgaactggtagagccagggggcggagacttcgaaatcccagttgccgacccgggtcgcccagccggcgacgtcgatcgcctccagcaccacctcgatgcccaccttcgacagggcctggcggatgtattcggcgaagcgcatccagacctcgccatagggcgggaccagataggtgatcttcgcgcgcttgccgtcggcgccgggcttcagccccatttcgtcgagcagggcgatcgccttggccgggttgaagtcgtagatcttgaccttggggtcgtagaatttcgtcgccttcgacatcggccccgtcgccggccgggccaggccgaacagcaccttgcggaccaggaaatccttgtcgatggcgtgcatcaccgcctggcggaaacgcttgtcgtccatcggcttgatgcggttgttgaactccagccagagcaggggcgcgtagaattcatagcccttggtggtgaattccacatgcggcagctgcttcagccgcggcacgtcgaacatctcgacatcgccccattgggtgagatcgacggtgccgttttccagcgccagcgcgcgcgaggcggcatcgggcacgatccggtagatgatttcgtccagatagggctggccgggcttgtagtactcgtcattgcgcaccagccggatatgcgagccgcgctcccactccgcgaacttccacgggccggtgccgatcggcttcgcgttgtgcgggttgttgcgatagtcggtgccctcgtagagatgcttcggcatgatcgggcaggacgacatctcgaagcattgcaggaaggggccgaagggctccttcagtttgaagaccacggtgtgggcgtcggcggcggtgatgctctcgcagcgggcgaagttgccgcgcgcccgggcatgggtctcgggcaggatcttggtggtcgagaacacgacgtcctcggcggtgaagggcgtgccgtcatgccacttgacggcctcttccagatggaaggtataggtcaggccgtcgtccgacatctcccagctcttcgccagggccgggcgcggcgactggtcgaaatcgaacttcagcaggctctgatagatcttgccggcgacggtcagcgtcggcgcctgctggttgatcgccgccaccagaaccggcggttcgggctggatgatcacgtccagcgtgccgccccggctctggccggcggcacggcggatgcccagcggaatgccggtcgatcccacgatcccggccatcagcatcagtttgttgaagtcgcgacggttcatggcgagccctgactcccttgatttgtatcccgcatgcatcggcgcgccggttctccggcgtcgccatggcctccccggccgtgttggtcccccgtggtgggggccttgtcgtcgtcaagtgtagggcccggctgccctggcccgcgtcgcggcatgggccatctttcgtcgcgtccgggccaaatccggtcggatgccgccggtcagtagccgcggccccgctccacagggttcagcggcggacgcccgcatgcggtccgccacgcattctcgacgatctggccgatgaccgccccgtcgctggcgatcgccgccatatgcggcgtcaccagcacccgcggatgggtccagagcgggtgggccgggtccagcggttcggcggcgaagacgtcgagcacggcgccgcgcagatggccgctgtccagcgccgcgatcagatcttccggcaccagatgttcgccgcggccgacattgatcacggcggcgccccggggcagtttcgcgaaggtggcagcccccagaatgccgcgggtccggggcgtcagcggcagcaggttgaccaggatctcgctctcggccagcagggcgtccagcccctcgggcccgtgatggccggtgatgcccggcaggctgcgcggcgtgcgcgaccagccggcgacggcgaacccctgtgcggacagcgcccgcgccacccggccgccgatctcgcccagccccagcacgccgatgcggcggtcggcggcggcctgctgcggcgggcgccgccagatgatcgccgggcggtcgcgcaggaccacctggtccagcccgcgatggaaccagagcaccgaccagagcacgaattcgctcatcgccgccggcaggctgtcgtccacgatccgcgccaccggcagggcggggtccagcccggcatcgttcagcacgccgtcgacgccggcggcgatcgactggaccagtttcagcttcggcatggtgccgagcaggccggcgggcggccgccagcagaccgcgatttcggcctcggcgccgtcatcctcgggccagacggtgatgtcgagccggggctccgccgccagcagcggcgccttcatgaagccgaggtcgagaataccgccgatcaggatcagtttcggcatggatgctcccgcatgtgtcgtccttccgggcgccggttgcatccggcgctgtcccgaaggatactgtcggggcatccgacctccgccgggacccgggccatttatcgtcgaggatgggccatatgctcggacatgccggatcttcggctttcgacacggcggcggagctgccgtctcccgaaccctatgtcaccgggatcgtcggccatctggccgcgcggtcggcggccgaacgcctgcaggcgatcgaccggccggtggtcggcatggcggcggagttcgccgccggcaatgtcggcagccatcacgatcacccccgcggccagatcgaatacgcgctgaccggggtgatgaccgcgatcaccgatcacggcacctgggtggtgccgccgcgcaccgcgctttggataccggcccataccatgcaccaggtgcgcaattgggggccgctcaccctgcgcacgctgtatctcgacatggaggtctgcggcgcgctgcccgccgaatgccgggtgttccgggtgtcggagcttctgcacgcgctgatcgtggaaatggtcgccgccccgcatgaatatgatctggacggccgcgaggcgcgcatcgccgagctgctgatcggtgaactggcccgcatgcccgatgtcgacctgcacgcgccgatgccacaggaccggcgcctggcgcgcatctgccgcgcggtgctgaaagacccggccgccgaacacgatctggaccactgggcggcggtgggcggcatggcccggcgcaccctgacccgtcagttccgccgcgaaaccggcctcaccttcgccgaatggcgccagcagatccgcctgctcgaagccctgccgcgcctcgcctcgggcgaaacggtgaccaatgtcgcgctcgacctcggctatgacagccccagcgccttcaccgccatgttccgccgcatcctgggcgccagcccgcgcgactacctccgcaccacggcggagggtgggcgggcggtggggtgaggggatatgttacgggcctgaaacgcgagacctggaaccgcagcccatccgctcgtccagcatgatccggatctcttcgaacgccgcttccccgtcaatggcggggccgctcgcaaggccttcgtcccacaggcgcacgatctcccggatcgcccgggtgctgcggtcgtccgcggtgccgtggacatcatcaatcggcggatcgcctgccatcgggcctgttccctggaatgagcgtcgccggcagaggctaacacggtcgcagcctctgcgaggagcccccacccgaaaaaaggcccggcacccccaagggtgtccgggccttcctccaccgatcggcacggcgagggcggggctgcgctttggtcgtgccgatgtcgggtgcggagatcagatccagtagggcggcacgccgtaatggcggtggaccgattcctcgtaagtccggtcatacagccgccgctcgtcgccgcggtcgtaggtcggtgcgttttccagctggtcacgggtcagattgaccacatagccctctttcgaggtatcgtatttcagcacgtcccagggaaccggatggtatttctcgccgatgcccaggaagccgccgaacgagagcacggcataggccacgcgaccgttcagcttgttgagcatcacaccatagaccgagccgatcttctcgccgtcggcgccgtagaccgaggtgccttcgacccggtctgcggaaatgaggttcgaggtttcggtcgtggcaggggtggccatctgagcgtccttcctcttgctgtccatgcccgccggccggcgggtacggacggctcaacgcttgaccggttcttttgttcccggctttaaactggtttaaactcagccaataattttcagctggcttggactattgaatcatgtcaacttttgcctgctccggaaacatcggaacccgcgcgggggcatgctactttcataagaaaggtctctacgaactgtggcacgggcgaatcctcgcatgagagacatctataccagaaaatcgccgcgatccggtgactgcctcatcgataaaatggggtattatctcgaattatcccgacaagacatagaccatctcgccgatttgcagcggcaggaacagacatggcgggtccgggatgtggtgcgcgagatgggcgcgcccacggaaatgttctatgtcgtcaagaccggctggtgtttttcctacaccatcatggccgatggccgccggcaggtgcttcagatccatcatccgggcgatgtgatcggcattcccgacatcgcctatgaacatgcggtcaccggcctgcaggccgcgaccgacatctgtctctgccccttccccaagagccggctggacacgattttcaccgacagcccgcggttgacggcgctgatcatgacgctcggcatgatcgaccacgtggttctgctcgaccggatccgcaccatcggccggatgaatgccgacgagcgtgtggcgcatttcctgctcgaaatcctgagtcgtctgcggatcaccaaccccgatgtcggcgacagtttcgagctgccgctcagccaggagctgatcggcgacacgctggggctgaccaatgtctatgtcagccgcaccctgtcgctgatggagcgcgccgggctgatcgagcgcatcgaccgctcgatccgcatcgccgacgagcaggggctgcgcgacatggcggatttccaggaccgctattatcgcatcgacacctcgtggttcccgggtggtgcgctggagaagctgtcggccggcgcctgagcggccgccttcaggctgcgaccccgggtcctctggtcatgggcgggcggccttgatagggtcggcccgttccgcatcacgcggacccggccggaggtctgcccccatgtacaccaccatccgtctgcgcaatgtcagggcctgggccgatagcggcgatatcgcgctggccccgctcaccctgttctacggtgccaatggcgccggcaaaagcagcatcgcccaggcgctcgatgcgctcgcacgcattgccgggcgcgggtttaccgatccggccgccctggtcgcggctctgccggcggcggccgtgcgtgacatgatccgcgaccgcgatcccacgcggctgatcggcatcgatctggcatggcagcccgatgcgtcgatgcaggctgccctggtgcagggcgcgcgccggctggcggtgtcggtcgaactgggcctcgatccggccggccagccgcggctgcacgggcttcactggaccgtgaccgatatggccgaccgcccgctgcgggtggtggcggttcatgacggccgccccgtggacaaggatgcagctgccatcgatgtgctggccgcggccaccgcggccgcggtcggtggtttcgtgatgctgggccccctgcgcgcccggccgcggcgcagctatgccgtgccggcgcgggtgccagccgatgtggggccgcgcgggcagggggccgtgccggccatggccgcggccgaccgcgccggccgccggctttcgatcggcgatggcgccgcgcgcggctttgccgacatgatttccgaccgtctggcgaccctcggcctggtcgcgggggtggagctggtcgatgccccgggcggcgtggcgctgatcgcccgcggccggcgtggcggccaggccccctttgccgaggccgggttcggcctgtcgcaggtgctgccggcggcggtggcggcctttctggtgccggccggatcgacgctgtggctggaacagcccgagctgcatctgcatgcggccgcccaggcggcgctgggcgatctgctgatcgacgcgctggaggcccgcgaggccggccgcgcccgccatctccagatcctggtcgaaacccattccgagccgctgctgaaccgcatccagcgccgcatcgccgaggcgcggctcgatgcagaccgcgtggccgtgcactggtgcccgggcacggtgccggccacgatcgagcggctggagatggacgagaccggcgagatcctgaactggcccgacgacgtgttcggcgacgagatggccgatgtcaccgcccgggcggtggcggcggccgcccgccgcaaagcccgccgggcgggtgagggggagggcggggcatgaccggatcggccgagcgcccgcggcggatcatcgacaccaatgtccttctcatcgccaatggcgcccatgacgacgtgggccccgattgtgtggcggcctgtgcgctcaccctgcaggagatattgcaatccggccgggtggtgatcgatgacggctgggcgatcctggaagaatacggccacaagctgcgccccaatcgcggcaaggggccgggggatgtgtttctgaaatggctgctgcgtcaggccggcaatccggcgcgctgcgaacaggtcaccatcacccccgacgaggcccgcggctgggccgaattccccgacgatccggcgctgggcaatttcgatccgcccgaccggaaattcgtcgcggtggccgccgcccaccccgcccatccgccgatcctgcaggcggcggattcgaaatggctcgactgggcgccggatctggcgcatcacggggtggaggtccgcttcatctgcaagggtgaggcgcagcgtttccaccagaacaagttcggccgatgaccggtttcttccgctttccccagaccgcccatgtcgcctggctgggtgcgggcgcgccgcgcgacgacaagctgctctcgcccgacgagatcgatcacctgctggatggcccggtggtgatcgaagaaaaggtcgacggcgccaatctgggcctgtcggtcgatcccgacaccgggctggtgcgcgcgcagaatcgcggccagtatctccatgcccccttcaccggccagttcgagcggctgggcgactggctggccctgcatgaagaccggctgttcgatgcgctggccatcgaccggctgatcctgttcggcgaatggctggccgcccggcattccctgggctatgacgcgctgcccgacctgttcctggccttcgatgtctacgagcgcgagaccgggcgcttccgcagcaccagggcccgcaacggcctggcgcagcagatcggcatcgaaaccgtgccggccctgttcaccggccgggtgaccgacggcgtcgacgggcttctgcgcatcctgaccggcgcccgcagccgctatcgcgacggcccgcccgaaggcatcgtgatccggcgcgaggacgacacccacctcatcgcccgcgccaagctggtccgcgccgatttcacccaggcgatcggcgagcactggcgccgccgggcgatcgagtggaaccgggttcagcattagaaccctaactatttattttgcggacatttaacaattaatgattgagaacgccccgccgaatcgggacaatcctctggtcacgtaaccacgcgcagacctccgtcgcccgcccgccgcatctgctttttgccagcagctgcgcccggctccctgcatgcccggcgccggtcgcccgcgggcggcggtgcgaagctgtgccgccgaccgggaggttttccgtgagtcgtttctggcaacatatcggccgtctgggtcaggggttggggctggcgcttgtgctggccgtcgccgctgccctgccggcgggtgcgcaaagcacccataccgcatccgatctgaccgaccgctattacaacaccgccgccgattgcggcgggccctcgcgcccggcctttctgtgctcgggcgtcatcttccgcgggacccgctattccaccgcctatcattcctgggatccgagcccgacatcggtgcggacgggcggtgtgtccttctcgtatctgcgcgccgatgcgcggttcgaaaacctcgccttcaactatcataacggctacaccgtctatccgatcttcggtgcgccgtcctgggcgatggatttcaatttcgtctgtgccttcccgctggacggcgccaccgatgcacggaccgatcaggggtgcggcaggcggaccgacgacaacaccaatcgcagcgccccctgccagtcgatcggcgttctgaccgccgagcagtggctgagcacctatcagccgcataattccagcaccggtttccgggcctgcggcttcaccgtcgccgaccacaccaacccgccccagggcacggcctacgccttccagcaggtgatccgggcgatgaaccagctgggcccggtctctctgggccagcagaacgagatgcgcgccgccacctgggcgcagggcatcggcgacaagctgccgatcgaatccttcttctacctggccaatgccggcgatcaggccctgctggatgcgcgcggtgaccaggccgattactaccgcaccaccggccgcttcgtgccggtgatccgcatgacgctgccgacggcgaacaagaacgccaccttccactatgtcgatgccgaccaggcgatcaagccggcggcggctgcggcctgcccgcaatacatcgaacgcggcagctggaccacccatccgggctcgccgcatctgagcctcagcctggtgccgaccgattgcgcccgcaatgtggcggcctcggcggcaagcgcggtcttcgccgaggttcaggccaagttcggcgccacgccccagtggcacaacccggccggcatggcggcgcagctgagctgccatatcgaaatcgcccgccacaaggccgaatggaacctggagcccgaccgccgcgccgacagcccggagcagacccgtaaggaagactgcaacccgcccttcgtctgagccttgcccgccccccccatgaaaaaccgccgggagccatatcgcccccggcggtcttcattgtccggtcgttccggtcgtcggccccgatcaatgcgcctgtgccggcgggtgcagctggtccagcaccttgcgcagcacgccatgggccacggccacctcggtaacctcgccgaccagggcatgatagcgcgcctgcgcgcccgcggtctcgccggcctctgcggtcgcaaggctgtcgggccccggccgcaccagggcggcaaccttgcccgcatgccgcgccacatcctcgggccccggcggcggcaggcgccgcgggctgcgggtctcgtcgatcgagacgatcagatccgaaatcgccttcaaccaggcgaaatccggatgtcctgtcaccagcgacaaacgctgatacggatccgcggccgcgccgaaccgctccagctcggtatcgagcatcgccttgtgaaccttgatcaacgccgccgacaacagcttcagcgcagcgcgggggtcggtggcaggcaggcggtcgatggcggtcatgcgatcgcgtctccttcatctcgccggttgcggaaccggcaatatgtagcgatcgcgggggcgaatgtcaccctgtggggtatgcaggggcagggcaatcgggtgaaacagtgcgtgacaggacggaaaaagtctgaatctctcgttgtcgacgttgctggcttgggagggatggatggaaccgtgtggggccttgggcgaagcgattgggtttcttgagcattttgaggagcttccggacgggcggcaagctggcaagattgtgtatccgcttgatgaggtgctgctcctgagccttctggcggtgctggcgggagcggagaccttcacggacatcgcgcgctttggccaaaagaagctcgatctgctgcggcgcttccggccattcgcggatggcacgccgccgcacgacacgctgggtgacatcttcgcgtcgctggacgcggagagctttcagcggtgcttcgtgtcgtgggtggcgtcggttaccgggacgcctgagggcgtgatcgccattgatggcaagaccgtgcggcgttcgggcgggaagaaggacgcgaaggcgcccatccacatggtctcggccttcgccgcccggcagcgtctggtgctgggtcaggtcaaggtggacgagaagtcgaacgagatcgtggccattcccaagctattggacctgctggcgatcgaaggggccatcgtgaccatcgacgccatgggatgccagcgcgacattgcggccaggatcaccgacaagaaggccgattacgtgttggccctcaaaggcaatcaaggatcgctgcgcgaggacgtcgccctgttcgtcgccgaacagcaggccaagggcttccaggatacgaccatcagccagcacgagaccgtcgacggcgatcatggccggatcgaaacccgcaagaccaccgtcatccatgatgtcgcctggctccgggcgcgacatgactggcccggcctcaaaagcatcgtcgtcgtggaaagcacgcgacggatcggcgacaaaatcgacagcgaaacccggctctacatcacatcattggcgctcatcgccgctctcgtcgggccgatcatcagaagtcattgggccatcgagaatagtctccactgggtcatggatatggtcttccgtgatgacgaatgccgggtgcgtacccaaaacgccccagccaacttcacaaccctgaagcacatggcacataacctgctgcgacaagcaccgggaaaggactccctacgcctccgacgcaaggtcgccgcctgggacgacgacttcctcgcaagcctcatcgcagtttaaaaactttcacccgattcccctgtatgcagggggcggggggccgtcataccgacggacgggttgtaccatgccgtcgcgtcatctgctgcagcaccacggccggttcggcgatatggcgggtcatgcggccatcgaggatgatgcccgcaccatcggtcccgcggacctcgaacagcagggagcggccgattgcccgattcagccgggcggtgatctctatggtgacgcccgccggggtgggggccagatgacgcaggtcgaagccgaccccgacggttgtgtggccgggcggcagggcggcggccacggcgcgcatgcaggccagttcggccagccagatcaccggtgccgaggccagggcggagacctctccctgccaggcatccgccagatcctgtgaccgcaccagatgggtcatacggccctcgagcccgggcgtcagcccgggcagtgtggcgatcaggtcgccgatctcgctcatgtctggatcctccggatcagagggcggcagccgcggggcggccccggccggttgcaaccgaaacgatgccaagtgccagacccagcaccaggaagacccggcggatgccctccagatcggcagccccggcgccggcgccggaagcgccggcaatcacgccggttgcgacctgccagacagcgacgccggcaaagaaacagaagatcagccctgccagcgcccggcccatggtttcaggcgggaagcttgccctgacgacggcgaactgaagcacatagaacgatccggccgcgactgcgatgcctgtcagcgccagatcgagagccagcatgcggccgccgatcaggcccagtgccgccagcgctgcggcggcgagcaggccaccgccggtcatcagcagccgccggcggtggccggggcggtcggcacggccgaagcccagcggggccaccaccatcactgccgacaccaccagcacgatattgccgatcgtcaccgcatcgaggccataggcggcatcgagaaaagggccgagccagaggccgcgcagcgtgatcagcgccggatatgagatgagggcgagcgctgccgtaccgcgcatcgccggcgaaatcaggatcgccagcgtgccgcggatgtcttccaccagccgggtgccggcggcccctgccgcaaccggcggccgtgccggcaccggcgcccgggcgaggcccaggtgaatggccgcggcgacgatcagtgtcaggaccgagcaggcggcgaaagcaccccgccagccgcccagttcgatcgcaagcgagagcggcgtgccggaaagcagcatccccgccccaccgatggaaaccacggcacccgagaccgccgcgaagcgctcggccggccaggcatggctcgcgaataccagcggcgccatcagcaggccggaacagccgatgccgatcaccgcctgcgcggcgaccagccagccgaaagctggtgccactgccgacgccgcggcaccggcggcggtgatcagcagcagcagcgtcgccgtgcgccgcacgcccagccggtccaccgccagaccgaccggaagctgcacaagcgcgaaggccagatggaaggccgccgcaaagacgcctaacccttctgcgccgatgccgaatcccgcctgaagcgggcccgccatcaccgccggcagggtgcggtagagatggctgagggcgaagccggccacaagcaggccgagcatcaccgttacggcgcgcggtacgtccgcggtccgtcgggccgtctcggggatggcaggaggggaggacatcgcgcggtgatccctgttgggcgggggagagggcagatggacaggagggaggggcaggcactgagatcttccagcccggtctgggagaatattcattccggcctcgactcggagattaggggcgagaatctgacatgtcaaaagcatgatttatggaaggcgtcattccagaatgtatatttgttgcattgcaaataagtggggcattcatgctgtggcgtgcccaccaaaatttgggtcgcctgcatgcccgagacatccgaggggctgcccgtatatggacgccgtggcatcacccgtgggcacattgcgccgcacactaaaaagtccataatatggattaaaaaaacagatcagccggagagttcggaggatgaaaggatgccggtgccggcacgcctgcaaacaggcacaacgattccatccgttgatcgatggccattccgcaaaattggacagaattgctggccttttttgcgaaaacagccggattatcctgtcatatggtgtgcggatccacggagatgggagccgttggaggtcgatgtgacatgcctttacatcgtccattatatggaccttacgtcaattattttgagatgacggattgaatcgcccgtcctgtggttgtatttatggaatggataacgcctggaacgatcgttcgagcggctgttggcgacccatagtcgacagctgtccctgacaataaaaaaacggatcgatttccgggctgaacggggagacgcaagatatgatcatgttcctgcccgccttcacgagacgctgagccggctgccacggtccggccaggctcgtgccttccgcgcgcaatcgggaggtgccgccgccggcccggcaggcagatcgacatttcaccctgaacatctggaatcgatcgaaccggtggcgggcctgggccgcgctgccggccaaggggatcatcatgcttcagaccagcaccgtgccagcatcgccgggcgtgctcgcccaacccgccttcgcccgggcgatcgaccgcctgtcgcagctgtccgtcgacggctattacaacccttatcgcagcttcgattggccggacgccatcgacgccgacagctggtggatgtcgcctgaactgctctcggtctcggggaccgagatgggagcagagcttgacgaggacaccctccgcaggctcgccaagtgggagagcatcaacttctacagcctgaacgtgcatggcatccgcgagctgctgcaggcggtcatcgcccgtctgcacgagcccggctatgaagtggcatcgaagttcttccaccatttcgtcggcgaagagaacgaccacatgtggttcttcgccgagttctgcatgcgctatgccggcaagctctatcccgaccgccaggtgcggatcgagacggcgaccgacccggcgatcgagaatttcctcaccttcgcccgaatcacgatcttcgaagagatcgtcgacttctacaacacggcgatgggctccgacgagcggctcgacccggccattcgcaagatcaaccacgtccaccatgtcgatgaaagccgccacatcgctttcggccgcaagctgatggtgctgttgcacgacgaactgcgcgccaagggtgacgaggccttgctcgacaaggtgtcggagtatctgcgccgctacatgaccgccagcgtgcgcggcttctattcgcccgacgtctatcgcgatgccggcatcgccgaaccgctggttctgcgccggcgcctgatggccgatccggcccgcgccgccttcgatgcgaaggtgctgcgccggaccaccgacttcatgaccgccaccggtatcctccgccccgtacgggaggccgcatgatgaccgacctcacccccgccgccgacgccgaggcccgtatcctcgagtggcttctggcccgcaatcccgaactccaggccatccccgacgacatggacctgatcgagagccgggtgatcgacagcctggacttcatggaattcgtctttctgctggaagaggtcaccggtcggtcgaacctgctcgacggcgtctcggtcgatgccttccgcagtctggcggctatccgcagcacgttccttgccggctgatctgcagcaccctcttgaggacgatcctgaggagttcccccgatgtgcaccgaacatgattgcggccacggccaggctgcggcggatacccccctttatcgtgcggccgaagacgggctggtgacgctcggccccgatgtcaccgaattgatgaccgcgctggatgatcacatccggtcctgggcccggagggttccggcccggccgatgatctacccgccgctgatgcgtgcggccgatctcgacacgctcgacttcttccacaacttcccgcatctgggcgtgatgaccgccggtatcgccgaaccgcatcaggcggcggtggcggaagaggccaaggccggcccggtcggcgtgattgcgggcgaccggctgaccgatgccacgcatctgctgcccaccgccgcctgctacaacatctatctggacctgcgcggcagccggctcgacggcccccgtttcaccaccaccatcggtcgttgcttccgccgcgagacccattacgacggtctgcgccggctgatgggtttcagcatgcgtgagatcgtctgcgtcggcccgcaggatgcggtcaaggcgcatctgaagaccttccgggcgaagatccgcgctttcgccgaccggctcgatctgccactcgaaattgaggcggcgaccgatccgttcttctcggcggatgcggcgcgcaccgccatgcagaagctgttcccggtgaaggaagagttcgtctatggcggctcgctcgccatcgcctcggtcaacttccatcgcaacttcttcggcgagcggtgcgacatccgcacggccgatggtgaacatgccttcagcggctgtgtcgccttcggtctggagcgctggatgcatgccctgctggatcagcatggcggcgatgcccgccgcgcgcgggcggcgctcgaggtcgcgatcgccgacgaggccgccgaggatgcggcactcggcctcgatgccggctcgatggtgtcaccgccctcggccgatgtcgcccaggcgccgcgcaagcgcacccccgccggagcggaggcgtgaacgccgacgctccggccccccggtccgcccccggtgagggggcggccgggcgggcagccggcagggtcggggcagccctgccggtcttccaggcggggatgggcggcatcgccgggccacggctggtcgcagccgtggccgaggccggcggcgccggcatcgtcgggctttacaagcatccgccgcaggagatcgcagccctgatcgccgagacggccggcctgaccgggcgcgctttcggcatcaatctggtgcccgaggtcgtctcggaagcagtgctggtcgatcaggtacgggcagtgctggcggcaccggcagagacgccgcccttcatcagcttctatggcctgccgccacgggcagcgatcacccccgcacgcgatgtcgggcgtgaggtgatcgtgcagatcggcagcgtgttcgatgcggtggaggcggtcaatcgtggcgccacccagttgatcatccagggccacgaggcgggcggtcaccatctgtcgcgccggccgatggccgatctggtcgcggcgctggtggaacgtctgccggcggttccggtgattgcggcgggcggcatctcgtcgggtgaagctgctgcggcggccgcggcggccggtgccgatgcggtgctggccggcacggctttcatctgcgcatcggaaagtgcggcgcatgatgtctaccgtgcgaaggtgatggcggcctgttcggccgataccgtggtcagcgaccgtttcgagatcggatggcccggccggccgcatcgggtgctgcgcaatgcggtgaccgaggcggcagtgccacccgagcccgccttcatcggccgcacggtcctgttcggccggccctatccggtaccgcgcggctctgccgccgtgccgaccatccatagctcgggccggatcgaggaaatggcgctctattgcggcacggggtgcgatgccgtcacccggatcgagcccgccgctgccatcgtcgcccgtctggcgaccggtttcgcggccggccgcaacgcgtcggcgacggacccgaccgtcacggctgcacccgtcacgcccgttacggcgcgggccggctgaaaagatcctccgggagatatctgatggacatcgccttcatgaccctcagccggctcgccttcggctattgggagggacagccgctttatgccatggccgagcttggcgtcttcgacgccctggccgaagggccggcacgggcggcgacgctcgccgaccggcttgccgcctcgaccgatggcatggtccggctgctcgatgccggggtggcgctccggctgctgacccgcgatcccgagaccgacggtcgctatcgcaacaccgagatggcgacgaagctgctgacctcgggttcgcccgataccctcatccactgggtgcgggtgatgggccgctggtcccggccgtggagccggctggccgatgccgtgcgcagcggcaccacggtcgaggatcagggcctgcggctgggggacgaccccgcctatatgcgcgacttcatcctgggcatgcatgaatatgcccgccgcggggcggcggaactgccgtccgccattccgcttgaagggctgcggcgcggggtcgatgtcggcggtggcgccggaacctatgccatcgcgctcgccaatgcggcgccggagctgaagctgaccgttctcgacctgaccccggtgctcgacatcacccgggcgatggtcgatgcccacggccttaccggccggatcgataccggggtgatcgactaccgcctggatcgtttcggcgaggatctggacctggtgctgatgtcgaacgtgctgcaccaggaaagcgacacggtctgcctgtcgatgctcggccgcgcccgcgatgcgctccggcccggcgggcgggtggtggtgcaggggcatttcgtccagcccgaccggacggggccgctcttcgccaccctgcacaacctttcagcgctcgcgctgtggagtggcggccacagccggacgctggaagagatggcggcactcgccggacgctcaggcttcaccgaggtcaccaccggcccggtcggcaagtccggcctgtcgatggtgaccgcggtaagggcctgatggtccgggcctgagggtcagcgatcaatcgctgccatgcggtcgggggcataccgttccccggcaacgaggccgggcggcacagcggcactgatcgccgcccggtcctcttccgtcagccggagtccagccgccgccagattgtcgtccacccgcgacggccgcgaggcgccgaagagggcgatcaccggggcggcctccgttcccgccgccagcacccaggccagcgccagggcggccggtgtggtgttgcgttccgcggccagtgccgccagccggccggcgaggtcggcgttgcgggcaaggttttcgggcgcgaagcgggggtagatcttccgcccgtcatccgccgcaagcccgccgccgccgaccgatccggcgagcaggccgcggcccagcgcgccataggcaacgaagctggtgccggtctcggcacaggcggcgagcaggccattttccgggtcgcgagagaccaaggaaaactcgctctgcaccgcggcgatcgggtaaatttctgcggcttttctaagggttgccggtgaaacttcgctcaagccgatctgtttcacccgccccttccgcacctcgtcggccatggcgccgacggtctcttccaccggcacatccggatccagccggtgcagataccagaggtcgacgacatcggtgcccagccggcggaggctcgcctccagcgccagcggcacccgttccggccggccgtcgatgccgcggagatcgccgccgccatccggccgcacgaagccgaatttggtggcgatctgcacccgctgccgcaggtcggggcgggcggcgagcgcccggccgaccagctcctcattggcgccccagccatacatgtcggccgtgtcgatcagggtcacgccccggtcgacggcatggtggatggtgcgcagggcctcctcggcgtcgcgggcgccatagctgccggtcatcgccatgcagcccaggcccagcaccggcacggccggccctccccggcccagcgggactgtcggaagctcgcgggacatcatgccgtctcctttccgccggtcgctgcggcaggctgtcgtccaagattgcgcagcgccgcccaggtttcgggcgtccagctgcgcagggcgggaagttccgggccggcggcgccttccaggcgccgaccaccatcgatcgccagcacctcgccggtaatatagccggcgccgtccgagaccaggaaggtggcgagatccgccagttcctgcggccggccggtgcggcccagcgcgacgcccgcctcggccggcggcaggtcggtgccttcgggccgcaatctgccgaaggcgccctcggtcgggaaggggccgggcgcgatgccgttcagtcttatccccgccggcccccattccaccgccagcgagcggatcatcgccagcacccccgccttggccatggccgagggcagtttgtagggcgcgccggtcagggccgactgggtcaggatgcacagcaccgcggccggcatgccggcggcgatccagcgccggccggcggccagcgtcacattggccccgcccttcagcacgatatcgaccacggcatcgatcgcccgcggcgacagggtttcagaccgtgccaggaagttgccggcggccgaattgaccagaatgtcgagcggccggctctggaaggcctggtccatcatcgcttcgacggcatcggcgttgcggacatcgcacggaaaacagtcgaccgccacgccgtggtcggcgcggataccctctgccgccgcctccagcacggcggcccgccgccccaccagcaccagatcggcgccgagttcggcatagcgccgcgcaatggcgagccccagcccggacccgccaccggtgatcagcgcccgacggccctgaagaagcccggatgcgaacatggatcagctccttgagttcttataacggctcaatacgccaccagccccggcagatacaggctcagttccggcagcgcgatcagcagcgccagcacgatcacctcgcccaccaggaagggcatcacccccttgaagcccacctcgaccttggtattggcggcgcccgaggccacgaagacgttcatgcccagcggtggcgtcaccagcccgatttcggcggtcttggtcacgatgatgccgaaccagatcgggtcgtagcccagcgacatcaccagcgggaaggtcagcggcagggtcaggatgatgatcgccagctggtcgatgaagaagccgagcagcagatagatggcgatgatcaccagcagaatgccccagggcggcagcggcagggtgccgacccagtcgatcaggttctggggggcgcgggtggcggccaggaaatagccgaagatcatcgcgccgatgatgatcgcgaagatcatggcggtggagcgcagtgtgtggcgcagcgccacgccgaattccttccgccccagaccgccccagccgaggccgatgaccagcgcgccggccgcgcctacggcggcggcttcggttgcggtgatggcgcccgaatagatcccgcccagcaccaggcagaccaggatcgccgccggccagaccggcaggatcgaggccatgcgcgcctgccggctggccttgggtgccgccggtgcaatctcgggccggcgtttcacccagaccaggatgacggtggcataggcgatcgcggtgagcacgccggggatgaccccggccatgaacaggctgccgatcgaggtttcggtcagcacgccatacatgatcagccccatcgagggcgggatcatgatcgacagcgtgcccgccaccgcgaccgtgccgaccgccagccggtcgtcatagccgtatttgcgcatctcaggcaccgagatccgcgccatcgcagccgcggccgccgtgctggagccggcgagcgccgcgaaaccggtggaggcgaccacggcggcgagcgccagcccgccccggacatggccgatccacaggaagcacatccggtagagattggccacgatcgacgaccgggccagaagttccgccatcaggatgaacagcgggatggtcgagagcaggaaattggcggcggtgcgatagggcgtggtctggagcacgccgagggtcgggatccagccgatcgccatcgcggcgccgaccgcgccggtcacacccagcgcataggcgatgggcatgccgatacagatcagcaccaccagcgccatcatggggagggcgacttccatcggggcgtctcctcaattcgtccggggcaggtggtcgcggatcggtaccgctggcccggcatccgccggtgcctggggcatggcctcgtccgccggcgcgtcatggggcagggccggcatgcggccgtccaccacatgcggcaccagggccacgccgcgcagcaccaggcgcagcgccagcacggccgatccgatcgccaccagcgcccagctcggggccgtcggcagcggcatggcgccgcccgtccagcgattggccttgaagttcatccaggcggtatcgccggacttccaggcaatggcggcgaacagcagggcggccgcgatcatgtagaccacgtccaggccgagccgcagccgcactggcatcaggttcagcagcaggtcgacccggacatggccgtcgacccgttcggtgccggcgaggccaaagaagaccacggccatcatcagatagaattcggtgatctcgtaagccgccgtcactggcgaggcgaacagatagcggccgccggcatctgccaccgtcagcaccatcatcaggataagcgccgccatcgcggcaccgtcgagcagggtttccagatggctgaccgcgcggtcgatcagtctcatggggcgcgtctccttcccgggcgggcagggttgcgaaggggaaatgcggcagcgccggcaggtcccgaagggggcctgccggtgcggcagaggtgccggtgccggccctcagcggctggtcatcagctcttcccattcatggaagacgcgggttccgggcaggccgcggccgtcataatccttcacccaggcggcctgaaccggcttcagcttgccggcccagaccggcacgcccgaggccgggatggcatagacctcgccgccgcgcttcgcgaggtcggccgcaaaggtttcggcgcgctcgacatagagcttctggacgtattcatccatctctttgccggtcttgatcagcaggtcctgaagatccttgggcagcttctgccagacgttttcgttgatcacatagagcgtcgggaacaggccgaaattcaggttgctggtcgaatagcgcagctgttcttccagcttgtagccgcccgcggtcgggatgttgaacagcgagccgtcgaccgttccgcgctgcagcgcggggtagagatccggcgccgggatggcgaccgcgatggcgcccagcgcctcgacgctgcgttcctgaatgccgcccgacgagcgcagctttacgcccttcagctggtcgggcgtcaggatcttggtcttggtggtcatcagctgataggcatgggtgaccgaggcctggatcacccgcacgccctggggcacgtattccacctcgttgagcgtgccgagggcgagttccgaataggccgcaccctgttcgcgcgggtcggatttgttgccgaccagcgggatggccgagaccgtcgacagcggcaggcggtccgagacatagagcggtgccgcataggaaatatccgagatgccgttgatcgcggcatcgagcagatcggaggatttcgcaagctgttcagcgggatagatctcgaacttcagacggccgttcgactgttcgtcgaccagtttgccccagtattccatcgcgatggcgccggtgtggcgggtcgggtaggaatgggcgacgcgcagcgtgatcgggtcttcggcggccgcagggccggtggtcagggcgactgccgcggcgacgaaggtggcggcgccggcaagccggcgggtccaggatgacatgggttttcttcctcccagtgccggcgaccctcttctttgcggagggtctgcccggcgttgtcgttggtgtggtcgttggttccgcgccgggatcactccccggcggcggcaagtggtcggggtgtttctgcggcggcgggggcgaggcgggcgagggcatccaccgccaccaccccgtccgggcgcacgaagatcgggttcacgtcgatttcctgcacccggtcggcggtggcgagcgccagatcggacagccgcaccaccagatcggccagggcctcgatatcggcccgcggccggccgcgggcgccctccagcagggccacggatttcagccggccgatcatgcgcagcgcctccgcccggtcgaccggggcgggggagaccgcgacatccttcaggatctcgacgaagatgccgcccgcgcccaccatcaccagcggcccgaaatccgggtcgacggtgacgccggcgatcatctcgacccccggtgcggccatgcgctggaccagcacgccgtggatgtcgatgccgggcagggcggccgcgaccgggccggtcagccgggcataaccatcccttatcgctgcctcgccctcgatattcagcagcacggcgccggcatcggtcttgtgcggcagctgcggcgacatcagcttcagcgccacccggccgccaagccgggcggccgcggcgacggccgcatcggcgccggtcaccagttcttcctcggtcaccggaatgcccgcggtggcgagcaggcgcttggcctgaacctcggtcagcaggcaggcgtccgccggcagcccggccagcgccgcgcgggcgtcgggagcagcggcggtctcgggcccggcccggcccagccgctccaccgcctcgcgatagcgcaccagatgggccagggctgcggcacagccggtcaaggtggtgaagatggtggtgccgagcccggccatcagggccgccacctcgggggcgggcggggtgtaggaatagaacaccaccggcttgccggcccgggcgatcgccgccttcagcgcttcgggcgagaaggcctccaccgccccaacgctgccgagcggcgccacgatcaccaccgcatcggcctcggtgctgtccgccagggcctcgatcaccgtgtcgaaggcggaaagcccctgggcggtgatgtcgaccgggttctgggtggcaccatagctcgggatcagcggccggatgcgggcctgcaggtcttcagacagcagcgggacagtcagcccggcctgttcgatcgcatctgccatccacgatcccgacccgcccgatgaggtgacgatcgccacccgccgaccgcgcggcaggctgcccaccgaaaaggcggcggcgatgtcgatcatctcgtcctggtcgtcggcgcggatcaccccatagcgatcgaagatcgcgtcataggcggcatccgatccggtgaggctggcggtatgagaggcggcggcgcgctgggccgccggcgagcggccgaccttggccatgatcaccggcttgccaagacgcgccgctttccgtgctaccggaatgagtttgtcgccgttcttcaccccttcaatgaacatcatcagctgcgcgacccgggggtcgtcgagcagggcatcggcgaaatccagcgcctccagatcggcctcgttgccggtggcgacgacatgggtgaagggcaggctgcggcgcacgccgcgattatagagcgcgaagcccagcccgccgctctgggcgaccacggcgacgccctgcgcgggcaccggcgcatcgaccggcgcgatctcggccgccgggctgaaggtggcggcggtgcggtccaggatgttgtagaagcccatggcgttggggccgatgatgcgcaggcccgtgcggcgcgacagcgccaccatctgcgcctgaacctcggccatctcgccgccctcttcggcgaagcccgacgagaagatcaccgccgcgcccaccttcgccgcggcgcagtcttccagcacgcccagaaccagattggccggcacggcgaccagtgccagatccaccccgcccggcacgtcacccacccgcggataagccttcaggccctgaacctcggcccggctgggggtcacgggaaacacctcgccggtatagccccgcttcagcagcagatgcagcacccggccacgaatgcgcacgatatcgtcggaggcgccgaccaccgcaatccgccgcggggagagcaggcgggcgatatcggcgctttgggaagttgtggtggtcatgtcggacggatcaccatcttggggaggagcgtctggggggagggaggcaccggccgcaccggctagcggcagccgcgcaccttgcgcggctgcaagccgccattgcggcggcggccaagggcacggagtgcccgcttgggccgagggactaacagactcggcggcggccaagggcgcggaagcgcccgcttgggccgagggacttacagccccgtcaacatcggccacagcgcatccccgccctggcctgcgatcttgcggcccagccgttcctgccactgtgcctcgttgccgaactcgtcgcgccagctccacagccggcgggtctgatagtgcagcgggtgttcgcgggtgaagcccatggcgcccatgatctggtgagcgagcgccgccccctcggtcgccgcctggccggtgcgcgacttggcgagcgccgcacgcaaggaggaactgctgccgtcttcggcaaagccgatctcggccgccgcactcgccgccgcggtttcggccgccagcaccgccagcatgtgctgcaccgcctggaacttgccgatcgggcggccgaactgctcacgctcgcccgcataggtcagcacctgggcgagcgcgcccgacagggcgccggcgatctggacggcgcggaaggccgcccccatcgccagcacctggtcggccgcatcctcgaccgccgccgaggcgacaggtgcctcgcctgcgaagaccaggtcgtcgcgcgcctcgcccgccaggttgatgtcggcagagaccgccgccggccgcgccgccacgacgatgtgttccgcgccgcgcccgtcgcgggcggcaaacaccacctgcgacagatggcggccaaagggtacccggcggagcgtaccggtcagctgcccgccttccagcgccatcgctccggcatcagccgtgccgatccccgtcagcccttctgcggcctcgcccagccctgccgtcttcagcagccggcgtgcggccatcacctcggccagcggtaccggcagggcgtggcgggcgacatggcgcaccagggcctgcatctcggctgggccggtcatgtcgtcgtcgatggtgtcggcatcggtgatgccggcggtctccatcgcctgccacaaccgttcggggaacctgccaccgtcggcgccctcgcgcatatcgcgggtcgcctccaccgcgaccagccggtcgacggtgcgcagcatcatgtccaggatatcgtcgctcatctgaggcccagcccccttgcgatcatgcctctcaggatctcgcgggtgccgccgcggatggtgaaggccggtgccgccacgacggtgtggcccagcagggcggccaggtcggcatcctcgcggtcgatccggggttccagcgccagcagccgccgcgcggtctcggggatcgactgctcgaaagcggtgcccagatccttgaccagcgccgcctcggtcgccgggcgcaggtcgcggtccagcatgccggcgatggaggtcgacatccggcgcagcgtcgccagttccgccaccttgcggccgatctccaccgcggccatgcggtcgggctgcgggcccgatccgtcgatgatctccagcagcagctgcacggtgctgagaaaccggtcggggcccgagcgttcgaaggccagctcaccggtgaccatggtccagccgctgccttcctcgccgatcatcatgtcgtcgggggcgaagacgccgtcgaacaccacctcgttgaaatcgtgcccgccataaagattgtagatcggccgcacctcgatgccctctgcatccaaaggtacaatgaactggctgagacccgcgtgtcggttgctgtcgctgcgcgccgcggtgcgggccagcacgatcaggtaatgggcgcggtgggcgttgctggtccagatcttacggccggtgatccgccagccgccatccacctgcaccgcgcgggtgcgggcggcggcaaggtcggagcctgaatccggttcggacatgccgatgccgaagaagcaggtgccggcgcagattttcggcaggatctcgcgtttcgcgcgttcgctgccgtggtggaggatctgatggccgctctggcggtcggccacccaatgggcgcccaccggcgcgccgccggccagcatttcttccgtcatcacatagcgttccagggccgaccgcccgcgcccgccatagctctcgggccaggtcatgccgatgaagccgcggcggccgcattcggcgctgaaggcggggtcgaagctcgaccaggaatggcgtctgggcgtgtagaggccggtgtcgcgtgcctccgtcaggaaggcgcggacctcggtcctgatggcttcggcggccggcggcatggccgtcggcgcgaaggtgaattcctgcatctcggctctctccgggggatgcgcacggcgaaagcgcgcggccaggaggtcccgccggctggcgggcatacctccgccttcatgccgaccgggggaaaacgcgcggcatcaagggtctggccaatgggctctcgtgcttgttctgcccggtcatgacagcctgaaacgccggtatctgtgtaggtaaaaattcgtttgtgcagtgcgatttcatatatgagttttgacaagatgccatgtcgccggtagggtgcgagagaaccatcccctcgggagagcccccaatgagccgcgacgtggtcaaatcggcggcacgtgtcattcacgtgctggagtatttcgacgacgtccgccgggcggtgtcggtctcggaaatcgccgagcatcacgactggccggtctccagcacctcggtgctgatgcggtcgctggtcaccctcggttatctcgattacgaggccggcacccgcacttacatgcccaccacccgcgtcgccctgctcggcaactggattcaggccaacctgttcaaggacggccagctgatgcatctgatggagtggttgagcgaaaagaccggcgagaccgtggtgctggcggcaaggaacggcctcggcgtccattacatccaggtcatccaggccaccaacaccatgcgcatgtcggtacgtctcggcacggtccggccgctctgctggtcgggatcgggctggatgctgctgtccacgctcgacgacgatacgatccgcaagctcgcccagcgtcacaatgccgatgtggccccggtggcctcgcccgaaaccggcgccctgtcgctgccgggcaagcgtgtcgacatcgccgagctgatggaggtgattgccgatgtccgggccaaagggtatgccttctcggccaaccaggtcaccgccaatggcgggctgatcgccatgcttttgcccacattgcccggcgacaagccgctggtcatcggccttgccgggctgaccagcgttctcgaaaccaatctcgaccgtttcgtcgccctgctgcgcgaagggatcgcgcttcatatcggctgagcccgaagactggccggtcgcctcaacaacccggaaggaaacgcccgcatgtccgaagcggtgctctacgaagaatccgacggcgtcgtcaccctcaccctcaacgagcccgagacccgcaacgccatctcgccggcgatcgtcgatgcgctggtcggccacatcgagcggatcaacaccgacatgtcggtgcgctgcgtgatcgtgaccggcgccggcgacggcttctcctcgggcggcaacgtcaagcagatgcgcgaccgcgagggcatgttcggcaacgagccggtgcagatccgccgcggctactggtacggcatccagcgcatcccgatggcgatgtattcgctggaagttccggccatcgccgccgtcaacggcgccgcggtcggtgccggctgcgatctcagcctgatgtgcgacatccgccttgccaacacgaaggcggtcttcgccgaaagcttcatgcgcgtgggcctggtttcgggcgatggcggggcctggttcctgccgcgggtggtcggctattcccgcgccgccgagatgaccttcaccggcgatttcgtgaaggcggacgaggccgagcgcatcggcctggtctcccgcatcgtgcccgacgaccagctgatggacgaggcccgcaagctcgcccgccggattgcgtccaacccgccgcacagcctgcgcctgaacaagcgcctgctccgcgacagccagggcgtgccgctgcccaccgcactcgaaatggcctcctgcatgcaggccctggtccagagcaccgaggaccagcacgaggcggtcagcgccttcctcgacaagcgcgcgccggaatttaaggggcggtgagggccaagggtcagtgagggtcggtgagtggcagaggatgggtgggcggcgtccctggcgccgcccattctcccgccccatatggtctctgcctgccccatatggccgccgccggtacgggctggcgtgacgtgccggagattggcataatccgcggatcccgaagtgggaggctcgcccatgaagatgaacgtatccctcagcgaggatcttgcgcatttcgttgaggcaaaggtcgccgacgggcgttacggctcgtcgagcgaggtgatccgcgatgccctccgcctgatggagaaggttgagcggcaggaggccgaaaagttggcatcgctgcgcttggcctggcaggaggggatcgacagcggcgatgccggcgagatcgatttcgatgctctgcggcagaaggcccgagcccggttcctggccgcccggggtccggacggtggagatgtcagcggtggagacgccgacgcgtgattgggcgcgtccgctttaccagccaggctgaagccgatcttctcgatatctggttgcatctggccgtccatgccggcatggacgccgccgaccgcctctcgcggcgtatcgagacggcatgcaggcgacttggaacctggccggaactcggacctgcccgaagagagatcgcagaggatgcgcgtggcctcgtgatcgagcgctggatcgcattctatcggattgacggcgccgacgtgcagatcgtgcgcgtgctcgacggttcgcgcgacctcacgatgctggactggccggcggtgacgccccctcccgtgcgcaggtgacgagcaactgctccctggcaacgaatacgtcaggctgccgtcttgaggtgctcaccctgccgatgcgctccgtcgccagcgaaaatcggccagggtgagcaccatcccgacgctcagccccgcggccagcacgatcattgccccggccggccccgtctctgccagccgggtggtggcgagcggtacggcggccaggatggcgacattgttcagggtttcggccaccgccagcaccatggccttgtcgggcccggcacgcgtggccagcaccaccgtcgccgccggcgcgccggtgccgagcgccgccccccaggccgccaggcacagaagcgccgcccagagcggcagcgaccaggccatgaacagggtaatcgccagggcaaggaccagggtcaccagaaccagcaccagctcctcgcggccgaacagccgccgcagccggccggccgagaggttgccgagccccagccccagcccgaaggcggcgaccgagacgcccaccgccgccggcccgaacccatagcgcagccgcagcacctctcccgagagcaggaaggccgcgaccccggtcccgttccacgcgcccttagcgatgagcgggcgtaggatcgagggtgaacggagccagctccagccggtgccttcggctcggcgggctgccgcaggtgcatggccaggcagccgtctccgtccgatgacgaagaccatggcacagcccgcggcggtgatgacgaagggggcgacccagccgatcagatcggtggcgatcccggccatggccggcccgaaggcgatgccggcggtcatgcccagcatcaccagccccatcgcgccggcctggcggtcgcgggggatcacctcggcgatcagcgcaaaggaagtggggatcaggattgccgaggcgatgccgccgaagatgcggagcgccaccgccacccccagcgtgggcgcaaggacgatggccagcccgtcgagcgcgaacagcagcagcccggccagcagcagccgcccccgatcgacccggtccgacagccagccgaacacgggggccgcgatcgcataagcgaccgcataacccgaaatcagccaggccgccccggccggcgtggtgtcgaaagcatcggcgagcggcgccagcatcgacgacagcatgaattcggtggcgccgacgaagaagacggtgacggcaagaagcggcagcagccggcgatccgccgactgccgcccggtagagatcatcacggccggatggtctttctgtttccggttccggccgcttgcccccagccgcatgccacgatgtcgggctggcagatgcgtcaggcaggctggccgcggaagccgatggtgaaggtcacgacatcgtcgcgataggcgctgaccacgcaatccaccgtcatgccatagaccgacctgaccaggtggctggtggagctgcagccgtcccaggccgcgaacagggcgcccgtatcggttcctccctcattgatccagatctgtgcgcgggcgttggtgaggcttcccgcgcccgggacgccgaaggccacatcgaccggacgggcatcatcgtcgccgatctggaaccgcagccagccgacggcgtcaccatcggacaccgggttccagacataatcggcgaaaacccagcccgcgggcgccgtctggtgggcggggatctggtcgacgggccaggcagcaaagccgccgcgcaggcccttgcgatcggtaagccggatcgtcaccgcgctttcgttgtagatgatcacccggcaggcatagcggccgccgaaagccaggctgtaaagccaggtgcggtcattggcgctggcccagtctggcagcagctgcggccagtggtcgggctggccgggatcgatcagctggaagcgggcgaaactgctctcggccgggctctgcacccgaagcggctgggttgcgtgcggatcggtgtcgcagccgggggtgaacaggccggcaatgcgcccggtggcggcaagcaccagccgttcgccgcgggcatcatatcgccagagctgatcattgttgcgggcctcgtcttgcgaggcaagaaccagcgtgccgtttcgatgggtcaggcacacccgcccgggggcatcttccgactgcgccgggaacaggcggccggcaccatcggtcgtccagacctggtgccgcccgatgacgaggcgggcgagcaccgcccggtgcccgtcgagatggccatcgccggtaccttcgatcgacagcgccatatcggcattcacggccagcgccgccgccgggtcggcggcccttcgggcgatgatgcagaacggggttttgatggtcaaccccgtcccgggacgggcatcctctgccttgcggcgatcgcgggccagatagggatcgcgcgtcgcatcggccccgtccgacgtcttcagcagggccgtcagttcttcgggcgacagcggatcgaccatccagagatccgacagacggaaggacccggtgacggccggatcgaaacgccccacggcggtcagcccggcttccaggccggtattgatcagatggccggcggcggtgagtgtccagctctgatagggtgccgtgtcgagggtggtgatcgccagtttgaaccggtccgcctgcggccggccggccgggccggttacgacatcgtcggtcagtgcggtcagggcgaattcggccgtggcggagcaggaataggcgatgatctgccccaggccgttttcgtaccagagctgcgatgccggatcggccttcacgtcggcatcgcgcagcccgacctcgacgccattgcccggctgatccatcagcagcgacagcaccttgtcgggctccatgcggttgcggatgcggaagtagaccgggcgtgcgctttcgcccgcaatccggcgatagtcgttgtagaacaggaaatgggcgcccttcgcctgcagctcctgcaccgtatggcggctggcatagtcgcgcagcaccgcccggcagcggcgcgccagatcgcgcggcagcagatcgatgctgggcatcggatcatcctgcatcaccgccgaccagcgccggtaattgccgagagatttcgcccattcgccggcatcggacagaaactgcccctcgccgcccacagcactcagggtcaggccctgacgctcggcggcggcaagcgcccgcgactgctcgcgggtggcatccttcatctcggccgccgcctgcgccgtgccgacccccagatgcgacacctctgccttcacgcccaccgacaggctgcgggtcacatcggccgtgccctcggtcgccgacagggtctgcacccgggtgccgaacagccggccgccgaccagggtgcggcgggcgacgaaatggccatagatcgccagcaccgccatcagccgctcggccgggtcgatcagctccggccagggatcgatgtcggccgggtcggcgggatcgagcgccgccgtcaccgccgccaggaaatccggcgccgccgcgggggtccggtcgtcgaaggacaggtccaccctgggcaggaaatagctggtgacgacgaaaaccgtcttgccggcctcggccgtggtggtctctgacagccggccgatgccgacacccaccccgatgccgccctggaaagagggcttgccgaccgcggcggtcatcgacatcgacaggccgaacacgccgttgcgctgcgcctgatgaacctgttcggaataggtataactggtttcgtaatagcccgacagctgcggcttcagatagaacagccgggtcggcccggtgggggtggccggtcgggaggccacaggcggtgcacccgccgcaggtttggccaccggctgaggctgggcgattggctcaggctgggcgacaggttgaggctgggcggccggctgggtggggctggcctgcttggcaggtttggcctgctggccggtggacgtgatcagcgccgccgcggctgccgccatcagcgcggcttcggtcgcccccctggtcttatccggatcggccggtttcgcatccgacagcccggtcaaccggcggcgcgtggcggcatcgccccgcaggtccagccggtagagcacgtcgcggaagctgcgggccgccacttcgctgcggctgtgatcgatcacgatgccccgataaaagccgatccggtcgagcagatcatcccgctgggcaaggttgagcgtgaagaaatccgaatggtcggaggcaagcgtgccgccgccggctgtaaagacacgggttgcggcctcggcggtgaagtcgcgcctggcgagcggcgtctcggccatggcggttgcgatctgtgcggtcggatcgggcaccgtcacccgcagccggtccagcagcttctgccggtcgtccagcgcctcgcggccacgctcgtcgcgccgacgcaccgccgcctcggcatgctcttccaccgcgcgatcggcatccagtttcgccttgcgggcggtgagcaccgcggtgtcgctggccagcatctcgatctcggccttgtcttctgccagtttccgaagccgcggctcggcggcgggaatgtcggagaagcaggtgaccgtcaggcttggctggccgtcatcgggatagttgaccgtgaagacctcctggtagggacggtcttctgccgcctccggcaggggctcgccgctggctgcgcggaaccggcagctctccggaatcccggccgcgaccagtcgccgtcgaacgacggcgaccgtatcccccagtttgaggtcgatatcgaccttgcggctggacacaagatcgccgttcaggtcgacccatttcacaaggcagagcatggcgcgccccttcggccttttggccgatcatgttgtcatatataaacatgatatagcagacatgcccgacaaaaaatgctatttgcggcaattacaggaaattttcatcttcgggaatattttcagagacttctaccaggcgcaccaggcagatgaggcgcaagacgtgcactatatagcacgttccggcggcccccgcagagcaaccggcacgcacccgccccccgcatggcagcccgtcggccacagacggtgttccgcgacgcacgggcatgtttaacttccggtgatctggccgcagcgggagagcccagccgatgaccaaagcctcggatctcgtcgtccaatgtctggagaatgaaggcgtggaatacgtcttcggcgttccgggcgaagagaatctcgatttcctcgacagcctgtcgcggtcggaaaccatccgcctgatcctgacccggcacgagcaggccgccggcttcatggccgcaacctatggccgccacaccggcaaggccggggtctgcctgtcgacgctggggccgggtgcgaccaatctggtcacggccgccgcctatgcccagctgggcggcatgccgatggtgatgctgaccggccagaagccgatcaagaagtccaagcagggccggttccagatcctggacgtggtcgacatgatggggccgatcaccaagttcacccatcagttcgcctcggccgacaacatcccctggcggatgcgcgaagccttccgcctggccgaggaagaaaagcccggcgcggtgcatctggaactgccggaagacgtggcgcgcgagaccacggacagccggccggtgccggccagcctgaagcgccggccgatcgccgaggccaaggcgatcagcgcggcggtgcgccggctggagcaggcgcggtcgccgatcctggtgatcggcggcggcgccaaccgcacccagaccagccgcatgctgtcgcgtttcgttcagaagaccggcatccccttcgtcaccacccagctgggcaagggcgtgatcgacgagcgcagcccgcatttcgtgggctgcgcggcgctgtcggctggggatttcgtccatcgggcgctggatgccgccgacgtcatcgtcaatatcggccatgacgtgatcgagaagccgcccttcttcatgaagcccggcggcgccgaggtcatccatgtcaatttccgctcggcggaggtcgacccggtctatttcccacagctggaagttgtgggtgatatcgcgaatgccctctggcagatcaccgaagagatcacccccagcaccgcctgggatttcgggatgatgcacagggcccgcgatgccggggcggagaacgtcgcccatgacgcggtcgacatgcgctacccggtctatccgcaacatctggtgggcatcgtgcgcgaagtgatgccgtccgacggcatcatcgccctcgacaacggcgtctataagttgtggtttgcccgcaactatcgcgcgcatgagccgaatacggtgctgctcgacaatgcgctcgcctcgatgggggcggggctgccctcggccatggcctcgcggctggtctatcccgaacgcaagatcatggcgatctgcggcgatggcgggttcatgatgaacagccaggagctggagaccgcggtgcggctgggcatgcagctggtggtgctgatcctgaacgacaacgcctatggcatgatccgctggaaacaggccgatatgggctttaaggatttcgggctgagctatggcaacccggatttcgtggcctatgcccgtgcctatggcgcccatggccaccgggtgagcgacaccggcgaattgccggccttgctccgccactgcctggaggcgccgggggtgcatgtcatcgactgtccggtcgactattccgagaacgaccggatcctgaaccgcgaactgaagcacaaggcggcggcgctctgacgacgccggcgatgcgggggcatccgcgcctccgcatcgcctgtcgcctcaggaccggcccgtcatctcagcgagactggcatctcagcgagacttgtgcggcctggcgagacaggcatcgaagatggcggccgtctgtgcggcggccttgttccacgaaaagcggccgacattcgcctggccgcgcaggatcaggtgttgacgcaacgcctcgtcttcgaccaggcgggacacggccgcaaccagcgcatccgcatccgccggttcgatatagagcgcggcatcgccggcgacttccggcagggcgccgcggcgcgtggtcaccaccgggcatccgcagagctgggcttccaggatcggcaatccgaatccctcatattccgacggcatcaccaggcacaccgcccggcggtaatgcgcggccagaaccggcgtggagacgccgtgcagccgcgtgatgccgacatcgcccgagcgggcgagggcggccgccagtgtcccatagggatcggtccccaggatgacggtgcggatgcccgcatgctgccacagccgggcggcagcctgcaccacggtctgcggcgatttatggggcaggacgctcgccaccatcatgatgaagggaccatgcgcgcaagccccgatggcatcctcgggatcatcgggcccgaatcccgggcccgccgcttcatgtaccacatgcaaccgcgtgccgaccctcagccccttggcgcggatgtcactggcggtggtttccgagaccgcgatcaccgcatcggcggttctggcggtcaggcgatccatcacctgccggaaccgggcctggtagcgttccaccgatccgggcaccatggcgtacataagatcgtgaatggtgaccaccttacggaagtcgccgagcagcggcccggtgttaccggggctgaacatcaggtgaacacggtgacgccgggcaatgcggggcagaatggtctgttcccagatcacccgctgaaaccggccactgaactgtggcacttcaacgacgcgcactttggacgccagatcggagggcagggcggtgcccgcctgcacgaacaccatcagttcgtatcgtttcagggcgaccagttcacggagcaatgaccacgaataggtcgccatgccgccaggaactcccggcgtgagaaaagccaaattcagtccgacgacatgcatcaaggaaaggctcggaaaggaccggggcgtcttcggacggaatgcccttttgggcgccccgtgacggcagacgaaaatactacgatctgctgtgcagagatacagcctattgaaggccaggttcaggaagccgcagggcaaagccacacggcgaccgcaagccccgtctgtcccctgcggttaccgatctcgatgcggccgccctggtcctcgaccagacgacgggtgatgtccagccccatgcccgaactgccaccgccgacgcccggttcggccccctggcccagaatggcgtcaccggcatcacccagccggtccggtgcgacaccggggccggtgtcgagcaccgtgaagcccggtcggcccgcgtcgttctggacgtcgatccgtacggtaccgcccggtggggtgtatttgatcgcattggccagcagattgacggcgatctgctgcaccgtggcggcatcggcgcggaccatcaccggcccgggtgcggacacttcttcaagctgtatggcggcttccagagacaatccatggaccaggcgcaatgctgccgcgagcggctggcgcagatcgatgacctggggcagcgggccgtcggtgtggcgcggccgcgccagcagccggttgaccaggcccagcatccagcgtccggcctcgtcgatcgatccggcccaggcgcggggctcctccggcaggcgctggtcggccgcaatcagggcggcatagcccatggtggaacagaggggggtacgcaactcgtgcgccagttcctgcactgcctggccgggtgttgcggccatgtcgaccagccgggtctggacccgcaccgccagatccatctgttcgcgcagatgatcattggcggccagcagttgcaggcgttccgcaaccagggcggcgtgggcttccagcatgcgcgtctgacggtcgtcgagcccgtcggggcggggttccgggtcgatgacgcaaagggtgcccagggcgatgccgtcgcccagccggatgggcgccccggcatagaagcggatgaagggcggccccaccaccagcggattgcccgcgaagcgcggatcctgcgcggcatcgggcacttccagtaccgtgggggcggcaagcgcatgatcgcagaaggcccagtcgcgcggggtttcggtggcatccagcccgtgccgggccttgaaccactgccggtcggtgtcgatcagcgaaaccagggcgatcggcgcccggcaaatgtcggagacgatatcgacgatccggtcgaagccgggttcgggcggggtgtcgagcacgcccagccggtcgagatgtgccatgcgtctgcgttcgcgcaccggatcgcgcccggccggcatgaaggtcttcccgatggtctccgatttacccgtgtcagccttcgtcacgatccgcatcctcgatgcatcgacccgttttgacagatgcatcctgccacggttgattgaaggaagtcttaaatgcgccgtatctttcaagcccgccgacggatcctgcgcaacgtcgcgaggctgccgtccagcgcggcgaacagggcgacacgggccgccgcctccagcctgcgggcggcggcacgcagcgccgtcagatccacgacatcgggcaggccgcggatggtatgaaggctgcggcgcagctcttcggctgacccgccggccaggcgggcgccagatccagcaggaaggtctgcaggcggtctcgcgccgcaagggctgcatcggggccgaggcttgcaaccagcgccgcgaagaccggatcggccgcgggcacgagcggcagatcgacatcgaaacaggtgccgtccgtggcgccgtcccccacggtgatccggccgcccatcgcctcggccatcagctgaatggccgccagcggccggtccccgccatcccgatacccgcgtctgccatgaacgcctccggacccgccttgcagcccgtgtccgggcgctccagagccgaaggatacgcggtgattgccaatgaactattgacggcattgcgggcgtgggcgtgcagccgtcgtcagacgcggtcggaatagcggtcgaaggcggtgacccggcgcaccggcaggtccagctcggcgcggcgatagatctcggtgcgcaggaaggtcatctcggcctccagctccgcctcgggcacgtcgcgccaccaggccttgggctggccgtcggagccgtcgttccagcgatagccgcgggccttcagggcatccttcatgtcgaaggggctgccttcggcgcggatgcgcatggtcgcctggcgggcgcccgccagcagcgcaccgagcgcggtcacccccgccaccgccagcggccgggccagaacttccagcagggcacggcagtcttccgccgcccggtggccgtcgtggaacagcccggccttgcccagaagatagccgagcttggtgccctccacaccctcggccgcccagtcgatgccggtctgagaacaggcccaggccttcacccgaaagatctcccagacatgttcgacgaatttgcggtcgaaggcggcgttatgggcgatgaccaccgacgcggcatcggcaaaacccgccacctccaccgggtcgatcgcctggcccgccaccatctcgtcggtgatgccggtcagtttcgtgatctcgggcgggatgggcatgcccggatcctgaaaccccgaataggcgccggtcacccggaagaccgtgccgccgggttcgaattcgaaggcgatcatgccgagttcgatgatccggtccttcgcatggtccaggccggtggtctcgacatccaggatcaggccgttgcgcacctcgccgcggcgctggaactcgcccttctcgccggcggtggaaaaccattcccgcggctcgatccgccgcaggatgcgataatcgcccgaggcttccagcttccgcgccatggcctccagctcggcacgggcgcgggggctgcgggggcgggtgggggcggtcatggcagtctccggctcacttgtaccaggccagctgttccgaggtggcgaccagcgtgccgcccggcgcccagagcgtcacctgctgatcgaagaatccgtcatggacccggcgggcgatggcttccagcagcaggaactgccccgccagcccgtccagcacctcgggacgggcatggatataagtggacagcgtgacggtcgaaatcggccgcgggccgcggtcgagcacgaagacccggggatagatcgcatcggcgaggccggcgaccaccgcggcatccaccgcacctgcgggctccccctcgaccagggcatggcgcagccagaccaggctgcggctggtatcggcgccggtgaagggcgggccctgaacgatccgcatctcataggccgagaaccagggcggcaggctgcggtgtgcatggcggggcgcgtcttccggcgccacggccgcaggcatcgcgaagcggggctcggtgaaatcgccggtgtcgcggcgggcggcggcggtgaaattgccgcgcgccgcgatggcgccgtcctggatcagatccacctgccagaacgacaccgaccggccgacgcgcgccggcgaggtgacgatggtgaacggtccctcggcgatcgcgcccatgaactgggtctgggtggcgacgatcccggcaccggggcccgcctcggccagccagccggcggcggcacgctcggcggcgcgggtcagcaccgcggcgatccagccgccgaaggggccgatcatgttccgccagaccgggtcggtgcggcccgaccagacgcggacgccgtccgccctttcctctaccggttcgatcgcgagggatccacggaaggcatcggggcggctggtggtcatgaggcgtgtctccggtcagcggcgcgtcgatgcgggccgtcatgtttttggggtcggggtttctttatcatgtctggctgtcctgcggcagtgcggtgttgatgcggccgcagcgcaaacggcggcttgcatctgagagtgattatcaatatcacttaaccgtagcgcctcgccgcagggaatccgtccgatgttcgcagatctcgccccggccttcagcggcccgttcgaccggttcagcagatcggtggtcggccccggtgatccgcggccggcgctcagcatccgggctctgaccgccgatcccgaggcgctggtcgaaaagatgctgcgccggctggcgcccgaggcctcgaccccgcaatcccggcgcggcgccgcctcgctctggacccagttctattttgcgctcgtcggcgtgccggtggtgctggcggcgatgcgcggccgccgccgtctgccggtcgggttggacgagatggcggtggtcatcggcgagaacggcctgccggcggcgttgaaactgcccgccgcgggggctccccagcccgatcgcgacccgcgcgcggcgatggaggcactgatcatcgatcattacctgccggcggtgaccgcgatgagccgggccggccggctggcgccccggctgctctggtgcaatgccgccgtccgcctggtctgggcgatggaggccgcggccgaggccgagcccgaggacaccgaattggccgggatcgcggcggcagcccggcaggcggtgatcgcgacccccgacctcagttgcggtgccgccaacccgatgttcgacatgttgctctcgcccaaaccggactccggctccagctatacccgcaaggtctgctgcctgcgctacatgatgccgggggtggccgattgcggagaaacctgcccgctgccgccctgccgcaccgcatgaccatccaggggatgcgcgaccggctgctggcggccttcctggcggaacgcccggccatgctgcgccggctgacccgtcgcacggggtctgccgcatcggccgaggacattctacaggatttgtggatgcgcgtctcgggtgccgcgggggccgggcggctggacggggtcgacaatccggtggcctatctgaaccgggcggccaacaatctcgccatcgaccaggaccgcgccgagcaggcccgccggttgagccccgacgaaatcgacaccctgaccacggtagagagcgaggcaccggggcccgagcgggcagcggccgcccgacaggagctggaggctctgaaagcagcgctggccgacctgccggcgcgccgccgggcgatttttctggaggcgcggatagaggaacgcccatatcgcgagatcgccgcccgctggggcgtcaccacccgcaccgtcgatgtcgagatccgcaaggcgctggaccattgcgccgaccggctggggcgccggaggccgggccggtgagcggtggaggcatgacagggcttggaaaaaagtctggcgcgtgcgattcgtctgccatacgccccgcacgtctgtcacgtaaggggggcggacgccccccacggtaccagtgccccgtccggcgccggccctgccccggccccagcatatgaaggccccgatgttccgtcgccgccccgatccggatgccgaggccctgaagcttgcccgcgcctggatggcccgcctgaaatccggcgaggccaccaccgatgatgccgcggccttccgggcctggcgtgcggccgatccggcccacgaggccgcctgggccgaaacggtgcggctgtgggaggcgagcggcgcggccgcggcggccgtccggcgccgcgatgtcgcgccgcgccgggcgatgagccgccgcatggtgctcggcggcggtgccgtcgccgcctcggcggcgatcaccgggcttggtgcggtgcggctggggctgctgccggcaccggcggatcttctggccgatcatgcgaccggcacgggagagcggcgcgagatcaccctgcccgacggcagccgcgccgcgctcgatgcccgtactgcactcgatgtcgacatggccccgggccggcgccggctgaccctgatccacggcgcggcggtggtggatgttgcaggcgggctgagcccggcgctggaagtccgggccggcccgggcgtggcgcgcgcggacgcaggcagcttcaccatccgccagatcccggtgccggccgacgatccgggcggcatgcgccggcgggtggtgtgcatcgcaggcagcgtgtcggtcaccgcgggtgaaacccgcgagcttctgcccggtcaggcggtcgattacgacgacaccggctgcggcccggtggtgggcgccgatgccgcactcgaaaccgcgtggcggcaggggctgatggtgttccgcgaccggcgggtggatgagatcgtcttcgagctgaaccgctatcgtcccggccgggttatcctgctggacgacaccgccgccgcccgtcggttgagcggcgtgttccaccttgaccgcaccgacgaggtggttgcccatctggaacgcatgctggccctgccgacccgcgacctgcccggcggcatcgtgctgatcggctgaccggtaccggtctcgtatgaagtttcgatgacatccgggacgaggccgccacggccccttggatcaggccccgtgcaggcgtatgagggcggcggttccaccccttcatcggccccttcatcggatgctccgcccatggccccccgccctatgccacccgaacgccccctgcctgccgaacgcccgaaacttgccgaaaccgtgatcgacgagaccgccagcctgcgcgaggtggcgctgggacgcagttgcgaggtgctggcgcgatcggcgctcgaatactgcacgctcggcgattacagctatctggggcccgattgcatggtggcggatgccgaaatcggccggttctgcgccattgcggcgcgagtccggatcggcgcgcccaaccatccgatggaccggccgagcctgcaccgctttacctattgcccggaatattacgatgcccgggccagccgcgacgctggcttctttaccgaccgtcatgccgaccgggtccgcatcggccatgacgtctggatcggccatggcgtgaccgtgctgccgggcgtgacggtgggcgacggtgcggtgctggcggcgggcgccgtggtcacgaaggacgtggccccctataccatcgttggcggcgtgccggcgaaaccgctccgcgagcggttttcgcgcgaggtcgcggcgcggctcgcccggatcgcgtggtggaactggcccttcgaggtcattctggagcggctggaggatttccggtcggatgacatcgaagggttctgtgaccggtgggatcctgcccacgacggcctggggtgaggtcaggcgggcagatctgccaccgcggcgccgatccgctcgatcgcctggcgcagcacctcgtcggcggcagcgaaagacaggcgcagatggccggggctgccgaaagcggccccgggcaccagggcgatgcgggcctcgtccagcagccaccgcgccacggcccggtcgtcgccgagccgggtgccgctgcgcgtggtccggccgatcagcccgccgatatcggcaaaagcatagaaggcgccgtcgggggccgggcagcttatgccgtcgatcgcgtccagcccggcggtgaccagccggcggcggcggtcgaacaccgccagatgatcggccagcacctcctgcggcccgtcgagtgccgcggccgccgccgcctgcgacggcgtggcggcgccggatgtgctctggctctgcacggccgccatggcctggatcagcggggcggggcccgccccccagccgatccgccagccggtcatggcataggccttggagacaccgttgacggtcagcacccgatccgccagatcgggcgccgcttcggccatggtcgcaaagcggcggccgtcatagatgatgtgttcgtagatgtcgtccgacagcacccagacttgcggatgatcgcaaagaaccgccgccagggccttgagatcgctcgctgaataaaccgcaccgcaggggttggacggcgcgttcaggatcagccagcgggtcttcggcgtgatcgcggctgcgagtgcctcaggggtcagccggaagccgtcctcggcccgcatgcggggcgagaccacccgcccgccggccagcgccacctggtccagataggatgtccagaacggcgccggcacgatgacctcgtccccttcgtccagcgtcgccatcagcgcattgtggatcacctgcttggcgcccgagccgacgatgatgttggcgggcgtcagatccagccggttgtcgcgggcatgtttggcgatgatcgcggccttcagcgcggcggtaccagtgagcggcgcatagcgcgtggcgccggcctccaccgcggccgcggcggcctctctgatatgggcgggggtcggcaggtccggctcaccggcggccagcacgatcacgtcgccacccatcgcctgcgcccgggcgccgatcgccagaatctcggacacgccgatcccgcccagccgccgggccgcgcgaaagccgtaagaagcctgtccggccgccctggtggcgccggtggtgtcggtcatggacatgtcgggtctccggaggagaagagcggggggtgggggtaagaaaaaggcgggtgccgtgtggtgtggcgacccgccttgcctgtgcgtcatggggggcagatccccccctcctcagatatcgaaggtgacgccctgggcgagcggcagcgtgctgccgtaattgatggtgttggtcgcccggcgcatataggccttccaggcgtcggagcccgcctcgcggccgccgccggtttccttttcgccgccgaaggcgccgccgatttcggcgcccgaggggccgatattgacattggcgatgccgcaatcggatccggcggccgacaggaagcgttcggcgtcgcgcagatcattggtgaagatcgacgaggccaggccctggggcacgtcgttctgggcggcgatcgcctcggccagatcgtcatggcgcagcacgtagaggatcggcgcgaaggtctcgtgacggacgatatcggcctgggccggcatctcgaccagggccgggcggcgatactggccctggcccatcacctcgaccacctcgccgccatggacggtgccgccggcggcgcgggccgcctccagcgcggcatccatggcgcgggcggcatcggcatcgatcagcggcccgaccagcaccccggcctcgcgcgggtcgccgaccttcaccgaggcataggcggccttcagccgggtgacgaagccgtcatagatcgagccatgcaggaacaggcggcgcagcgtggtgcagcgctggccggcggtgcccatggcggcgaaagcgatgccgcgcagcgccagttccagatcggccgaaggctgcaggatcgcggcattgttgccgccgagttccaggatggcccgaccgaaacgttccgcgacccgggggccgaccttgcggcccatggcggtggagccggtggcggaaatcaccggcacccggcggtcgtcgaccagcttttcgccgatctcgcgcccgccgatcagcagcgaggccagccctgcgggcaccttgccatggcgcctggccgccttttcgaacagggcggtgacggccagcgcggtcagcagggtcttttccgacggcttccagatcaccgggtcgccgcagacgaaggcgagtgcggcattccacgaccagaccgcgaccgggaagttgaaggcggtgatcacgcccaccgggccgatcgggtgccaggtttccatcatccggtggtccgggcgctcggtggcgatggtcaggccgtggagctgacgcgacaggccgaccgcgaagtcgcagatgtcgatcatctcctgaacctcgcccagcccctcggccggcaccttgccggcttccagggtcaccagccggcccagatcttccttggcggcgcgcagctcttcgcccagcagggcgaccagccggccgcgctcgggcgccggcaccaggcgccaggccttgaaggcctctgccgcgccggcgatcgccgcctcggcctcggccggggtggtgtcggtcagccgggcgatctcggcaccgtccagcggcgagcgggcgatgcggtcaccgcccgacagccgcgccggatccacccccaatcgggcgaggacggcacgggcatcgtcggcagggctgagccgggtctcggtctcgcgggtcatggcgctctgaactcctgggtcgtgatcttgtccggacgcgccgggccgcctcttcaggacgggccgaccggcgcaatgggctggcggcatcatagggcggggcggggcggcaggcacgtggcattcgtgcctgccgaggggcgcacccgatcattccctggggaaatgataccgttaaaacaataaattacgggcgagaactcgcgttccgacgtcagaacccgccgcatcgggccgatggccacccatcggcccagccgccattgaggcggcggccaaggccacggtagtggccgcccggcgagggactaacagactccggcggccaaggccacggtagcgcccgcccggcgagggccaaacagactcctacgccgccgcggtcatcttgaagatgccctgggcattgctgctgtcgaagcccagatccagccgccggccggtttcggtcgccagtgtgtcgggcagggggtcgcgggtgatgaactcgtagaagctgcccggcacgatgcgggtgacggtggcgcccgccgcatcccggaacggccgtgccacctcggcggcgcgataggcagtctggcgcacccggcccgaggccgagacttcgaccttgtccttgatcggccggccggcggcgcgctcggcctcggccagggcgtcgacatcggccacgcggtcggtggcgtggttgaaggcgttgccctcggtcgcgatccaggccatttcggccgactgcgccttcaacgcctcgtaatcggccagcgccggcaccccgtgctggcggtcgaaacaggcgaccagcaccggcagcagggcggttgcggtctcgatgtccagcgtgccttccgccgccagccggtccagcgcggcggcggcctcagccgtcagcggatcgcgcgaactgccggtcacccgcagcaccgccgcctcgaaatcggggccgaagcgttcggggtgcagctcgctcacgaagaactgggcgatgtcctcgggcagatctttctgggcataggaccggccggtcatcttcagccggtcgagcggataatgcccgacctgggcatagcccagcggctccaggatgcgggtgatcgcggcttcgccggccggcagggcgccctggccggccatcgccaccgtgcgcacggcgccgtgatcgtggcagagcgtgccgccggccgccacccgttccgccacataggccgccgcggccggcacccggtcgatcagatcggcgaagagcagcatgttcagcgcctgggcgatcacggcgcgcgaggcgcggtcgccggtggcgccggccagcgccggatgcacgaccatggtggtcatcaggccgtcggtccgcgcggggccggcgacggaggcgacgaggcggtggagcacggtcgtgtcacgggcggtcatctgcacactcattcctgatgggccggaaagccctgacgggcgatgtctcggatgtcgggccgcggggggtgcccgacgccagggatcgtgcgatactgacggctggtttgggaaacgatgaataatggggaggtcatgagtttcgggaatgatctgccgtcgaagcgcgggctgatcccgtcgctcggcgcgctgctggctttcgaggccgccgcccggcatgagagcttcacccgcgccgccaccgagctgaacctcacccagggcgccgtcagccgccagatccgccagatcgaggatcagcttggtctggcgctgttcgtgcgcgtgcgccaacgggtcacgctcaccgatgccggccggctctatctgggcgatgtccgccgcgccctggtcgatctgggcgaggcgacccaccgggtgatggcgctggccggccgcggccggatcctgaacctcgccacgctgcccaccttcgccacccgctggctggtgccgcggctgccggattttttcgcccgccatcctgatatctcgatcaatttctcgacccggctgtcgcccttcgatttcacggccgatcccttcgatgccgcgatccattacggccgtgccgactgggccggcgccaccgcgcaccatctgatgcgcgaggtgatcgtgccggtcgcaagcccggtctggcgcgccgcccatgcccccgaccgcctggaagacctggcccgcctgccgctgctgcagcaatccacccgcccggccgcctggccggcctggttcgcggctcaggggctggaggccccggaaaccgtgcgcggcatggtcttcgaacagttcgcgatgatcgcccaggcggctgcctcgggtctcggcgccgccctgctgccccgcctgctgatcgaagacgacctcgccaccggccgcctcgaagtcctgttcgaccgcgcgatcgtgcccgacgaggcctattggatcgtcatccccgacgccaaggccggccagccggcggtggaggcgttccggcggtggattgtgggggcagcggggcattccgagggcgggtcgtaacaaatcgtggacggccctcgcgtgcgggatcttccggccccacactcatgttgaacaaggcggggacacatccgccctcgacgaacaacggagcatcgagcgccatgatcaagaccatgttgggagcggccggcacgcctgcgctggcggtagagaccgtaccggccctgagagaggtgcgggtgggggaggtgctggatggggtggtggagatcgaaggcggggttgcggccctgcatatcgcgcgggtgacgctggatctggtggtcagggccctgatccatcccgatccgcgccggcagccgaaaggtgagggggaggcgggtgagggggagcacgcgcccgagccccatcacggtctgatcatgatcgcggccgagaccatcgccaccgatctgacgctcgaccccggcagctgctggccctgccgttcgcgatcgagatcccggcccatgcgccgctgtcgctgggcgtgtccaccgccgggctgcgcacgcgggtggaggtggatggcgcccaggacggcgccgatggcgacgccatccgcattctgcccgatcgctggaccggtgcggtgctcgatgccatggagcatctggatttccgcctggccgaggccgaggtggagcatgtgccgggcgatgcctgccccttcttccagaccttcgtcttccggccgatgtcgctgcgcgatctgcgggtggaatgcatcgacctcgccttccgcccccgggaccatggcgtgcatgtcgacatcgtggtcgacaatcgcggcagcctgttcaccgccgcccgcgaaagccgggtcgggctcgatatcgacgacgagctgctcgacatgggcaccgatgccgtggccgggctgctgcgggaggaaatcgaccggctgaaaggcccgatcgtcgcctgagcggggcggctgcggtccggattcgtgcggtctgcgaacatcgaccgcaggtcgtgcacatcatcttgaccatgcgggggttcgaccgtgagatgggcgcatccctggcccatacggaaccccgcccgatgatcgacaaacaggtccccgaccccgccaccgcggtggccgacatccccgacggtgccaccgtcctgatcggcggcttcggcgaggccggcagcccgatcgagctgatccatgcgctgatcgaccagggcgcccgcgatcttgtggtggtcaacaacaacaccggcaatggccgcgtcggtctggcggcgctgatcggcgcaggccgggtgcggaagatgatctgttcctacccgcgctcgtcgaattccgaaaccttccccgatctgtaccgggcgggaaagatcgagctggaactcgtcccccagggcacgctggccgagcggatccgcgcgggcggtgccggcattcccgccttcttcaccgcaaccggcgtcggcaccgtgctggccgagggcaaggaggtccgcgagatccgcggccgccgctatgtgctggaagaggcgatcaccgccgattacgccctggtgcgggccgagcgcgccgaccggctgggcaatctggtctacaacaaggcggcgcgcaatttcggcccgatcatgtgccaggcggcccgggtcgcgatcgtccaggtccgcgagatcgtcgccgtcggcgccatcgatccggaacacgtcatcacccccggcatcttcgtcgaccgggtggtcgccatcgccgatccggcgcaggaatccgtattggttgcccgcggggagcagtatccatgaccaccgccaccagcaccttcccccgcggcatctcccgcgatgccatggcccgccgcgcggcgctggacatccccgacggcgccgtggtcaatctgggcatcggcattccggaactggtcgcgggccatgtgccggccgggcgcgatgtgatctatcacaccgagaacggcattctgggcttcggcccgccgcccgaacccggggccgaagaccccgagctgatcaatgccggcaagaaaccggtcaccctgctgccgggtgccgccttctttcaccatgccgacagtttcgcgatgatccgcggcgggcatatcgacatctgcatcctgggtgcgatgcaggtggcggccaatggcgacctcgcgaactggtcgaccggggccgccgatgcggtgccggcggtgggcggggcgatggatctggtggccggcgtgcgccgggtcttcgtcatcaccgagcatgtcacccgcgacggcgcgcccaagctgctcgatgcctgcacctatccgctgaccggagccggcgtcgtccaccgcatcttcaccaatctggcggtcatcgacgtcacgcccgagggcttcctgctccgcgagcatgcgccggaggtctccgtcgacaccatccgcgcgctcaccggtgcgccgctggcgctggcggcggacctgcaggtgatcggctgatgcatcaggatgtcggcaacaggaagacgatcgtctgatcatggaagcctttgccgatgtcgatgccggccttgccgatgtcgatgccggccggatgatcgatcatcagcgcgttcaggcccgggccggcagccttgacggtcccgtggcgctctcactccgtcattgaaggggcgccggccgggtggcggcaccgccatcatcccacgcaacctgcgccggcaaaaatatgcctgcggttgtaaaaaaatcgcgccaccccctgaaaattcccgccggccatccgtctcctctggtactgcaaatgagaatcgtttgcattattacaaccagcagaggtgaaacggcatgagctggggcgacgagaccaccgtgttcgacgtggtgatcaaccacgaggagcagtactcgatctggccgagctacaagcccattccggagggctggcgcgcggtcggcaagcagggtccgaaggccgactgcctcgcctatatcgacgaggtctggaccgatatgcggccgctgagcctgcgccgcgccatggcggcgcgcgaggcggagcaggctgccggcgccgcgcccgcggcgtcgtgatccgaaccccttcctgacgcgctccccgcctgtgaagggtcaggtcatcgtgaatgccaccactccccctctcgctgccgatcttgtgatcggcagtcttcaggccggcgccacccggatcgtgacggtcgaggcggccggcgccgggccggcggcggagaggctggatgcgctgcgccatctggccgatcgccatgtcgagaccgccggcgggttgctgatccgcgggctcgatgtttcggatgccgccgccttccacgcgctcgcccgcggtttcggccatgatctgctggcctatgaattcggctccaccccgcgcagccgggtggggcgggggtctattcctccaccgaatatccggcgcatcagtggatcccccagcataacgagcagtcctataccgaccgctgggcgatgcggatctggttcttctgcgatgtggcgcccgaggatcggggcgagaccccgctcgccgatgcccgtgcggtgctggcccggatcgatcccgcgatccggcgccgtttcgcgcgccatggcgtgatgtatgtccgcaattacggcggcgggctggaccttccctgggaacaggtcttcggcaccgacgacccggcccttgtggagcggacctgccgcgcccgcggcatcgcctgggagtggcaggaggacggccgcctgcgcacccgccaggtctgtgcgtcggaagccgtgcatccgcgcaccggcgagacggtctggttcaaccaggcccatctcttccacgtctcggcgctggagcccgatctgcgcgagaccctgctcgccgtggtcgacgaggaggacctgccccgcaacgcctgctatggcgacggcagcccgatcgaggatgcggtgctggacgagatccgcgccgcctatgcggccgagatgctgcgtttcccctggaagcgtggcgatgtcctgatgctcgacaacatgctgatgacccatggccgggccccgtttacggggccgcggcggatcctggtcgccatggccgagccctggggcgccaccggccccgcctgatcccgcctgatcctcccctcccatccgaccctcacggcatttccgaacgggagacccctgccatgcccgcgacacccctcttcagcttcgccccgcgcgccgccgaggccgatgaccagctcgatctgatccgcagcttcgccgaccttcacccctatcgcagcgcaatggtggaagagcttgttctggatgaggatttctaccgccggccgctgcgccccgaagacctgtccttcatccgcttcgacgagccggtcacgccggataccgtcaccctgctgccctctctcgcctcgcaccgcctgctgctgtcgatcaacgagctggatgtcgcccggctgccgcgggacggtgcgcccgaggcctttgccgcattcgaccatttctacggcgaggaaagccgcctgctgggcggccgcatccggcccttcctggaggatttcgtcttcgaccatctggccgcgggcgaggccccggtggcgccggccgatcagacccggctgcttcgcgacgtgctgaaccgcgaggccggctttctcggcacgctctttgcccatctgaagcgcgccgattatctggaagagggcatgcgcttcgccctgatccagcactggtgcctggccgaaagccggcggcttgccatgtcgcgtgcccgggccggcggctggttcgggccgttgggcgacggtgcgccgcgccttgtgctcgatgccgtcgacgaccgggcgatcgcgcggctggcgcgacgctgcggcgtcgacctcaaaccccattcctactggcagttctatctgtcgaccagcatggcgcgcgccaatctgctgcacgcgctcgcccgccgtcccgatcgggcgctggcgctctggggcgccggtttcgcggccgaggccgaatggatcgccttcggctgcctgctggcccaggcgggcgaggcgctgggcatcgagggggcgacgcctgccggccacaaccgccacccggccgaggcgctggaagatctgggccgccgcttcggccgcgcgctcgaactcgccgaggcccgctggggcgaggaaggtctggcgcggatcggccaggggctggcggcggcgtcccgcctgcgcgatgccgccgagcgcgatctgggcgagcagctggaatggctctcggccatcccggcctatcgcgagatcgcggggaagatcgatgcccgcatccaggccgaatgccccgatatcgaccgcgagaccttcgtcgagccgcgcgagatgtgctccaccacccatgtccatgacgactaccggctggtcgcgatcgagaccggcgacatggtgttctggggcaatctcggcatggagctgaagcttgcacccagcgagatggtgctggtgcccatgggccggctgcacggctcctcgatcctctccgaggaatgcgtctaccaccagccgatcatccccgaggaatggatacatccgctggttgcagatctgaagctcggcgcccgcgcctgagccgtttcacgtctgccatctcgcctctgccgtctcgcttctcccccgccgccgacaggactctggagtacggacccccatgaacagcgggcgcatgcttcccgaagaccgccgccgcaagcccaccccctggaccgcccggctgatccgggatgacgggcttgtcgcgacgccgccgccggcctggctgccgccgttctacgacctgttccatgccaaggtcacggaccccgcctatccctgcttcttcggcacgctggccgagcgcaagggagagatgttctacgcctgggtcgaccgggcggacgatctttcgggcgtgccggcggcgatggcgaccttcctcaggcttgccgccgagcggccggaggagaagaacaactttgcgctgttcttcccaccggagcctgaaccactctcccattccgcctatcgcgaccggttctggcgggtgcttcagcatctgcatgaccatgacccggcgcccaccttcgaaacgctggaaaccgagcccgaggatgccgcctgggaattcggcttcggcggcgagcagatgttcgcggtcggctgcgcgccgtcctacaaggcgcgcgacagccgcaatctggggccgggcatggtgatcctgttccagccgcgcagcgtgttcatcgacaccatcaccaagcgcgagatcggggccgaggcgcgggcggtggtgcgcaagcgcctgctggcctgggatggccagcccgtccatcccgatctcggcgtctatggcgacaccgacaaccgggagtggaagcagtatttcctggccgacggcaacgacccggaagccgggcgctgccccttcctggtccgccgcgaccgcagcttcgccgacacgctcaccgccctgctggtcggccgcggccgccatcaggccgacctgccggccatcgccgccccggccgacggggcaggggaccatgccgcgaccggacgccatctgacctatggcgcgctggacgcccgcgcccgcgacctcgcggcccggctcgccgaccatgcccgcccgggcgaccgggtgatgctggttctgccggcggggcccgattatgtcgccggccttttcgcctgcctctatgccggcctgattgccgtgcccgcgggggcagggcagggggccgatccggcacggctgcaggcgatccgcgccgatgccgccccccgtatcctgttgacgaacaagggctctgaatcgattatggccaatatggccataaaaggtgatgaaacagtcatctatactgatacagcctccgacgcggccccgcgaagcttcgaacctgtggttgcatcgccggaaagcccggcctttttgctctatgaacccggcccggccggatccgggccgggcgcccgccggggcgtgatgcacagccatggcagcgtcatggcggcactgctggtcgcccgccggctgctggggcttgcccgcggcgatgtggtggtcaatgtgctgccgcccgaccaggcggcggggctgatcggcggggtgctggcggcgatcttcgccggggcgaagctggtgatggcggacccggaccgggtgcaggccgaccccgtcctctggctgcgggcgatcgcctcccagagtggtgaaatttctggcggtacaatctccggcggtaccgatgccctctggcggcgctgcctcgaccgggtgcaggccgccgatctggccgggctggacctctcgcgctggcgggtcgcctggtgcgccaccggcaccctgccggtcgaggtgctgacggccctccgcgaccgcctcgccccggccggcctggcccccaccgccttccacccctgccacggcctggccgaggccgggctgctgatcgcgggcgcgacacccggcgccggcgcccgcatcgtcgatgccccccgcagccatgcccgcatcggcaccgccacggccgccgccccgcgcctgatcgcctgcggcccggcagcgcccggccacgagatcgccatcatcgaccctgccacccgccaccctctgccggccggcagcatcggcgagatctgggcccgcggcccggccgtcgcccgcggctactggaaccgccctgacgccaccgccgcgacgttcgatgctcgcattgccggtagtgacgaccgcgaaaacacgccgtggttgcgaaccggcagcctcggcgccctgatcgacggcgatctggtggtctgcgattcgggggaagctccgggtctcgccgccgaggccagccttcccgccaccgtcggccaggaggggttctggatcgactggcagctcgacccggccgatgcccgctggaacgtctccgcccgtctgcagctggccggcgatgtggcgcccgaagccgtgcgggccgcgatggcggccatggtcgcccgtcatgatgcgctgcgcgtgcgtttcgcggaggagggcggccggcttcgccagctgatcgcgcccgagccggtgttcgagtggcgggccggtgccgatgccgatccggacgaggccgcccgccggcccttcgatctggcccgcgggccgctgcttcgtgccgatctggtacccgacggtcccggccggcaggtgcttcaggtcgtcgtccaccatgccgtcaccgacggctggtcggccggcatcatgctccgcgatctgatgctggcactggccggccggcggctgcgtccggcgccggattatgctgcggcgatccggtcggtggcgctcgatcccgatcaccttgcccatgagatcgcctggtggcgggaccggctggccggagagacccctgagcttcacctcccccggcgtgcgggtgcaacgccgggtggtccggggcggcgcgtgtcgcgcatggtgtccgcgacgctcgccgcccgtctggccgaggccggccgggcccggggtgccacccgggcaatgatgctgctggcgggcttcgccgcactgctccaccgccatggcggcaccgcggccacccgcatcggcatcgcgcgggcagggcggggcgccgccgcttcgcgtcatgtggtgggtttcttcgtcaacaccctggttctgcacacggatattcccgcgggcctcgatgccgccgggctgatcgagcgggtgcgcgacgggctgcgcgaggcggaagcccatggcgatctgcccttcccgcggctggtggcggcgctgcggcccgaccggcggaccggccgcaaccccctggtcagggtgatgttcaaccatcagcccggccggctggatcgccgccttgccgacggccccgccgcgctggccggcatcgagctggacccgggcacggccgagatcgaactgtcgctgggcgtcagcgaaaccgccgacggtctcgccatcgccttcgaccatgccgccgccgccttcgccgccgaagacgtcgagcgcctggccgacgactatctggcgatcctggaggccctggcgaccgaccccgcgcagaagctcggcgccctgccggtcagcctgccggcaccgcagccggcggtggcgcctgccttccgatccgccgccgcccgcatcgcggcgcaggccgccgccgaccccgccgcccgggcgctgatcgtcgaaggccaaagctggagccgcggccgtctcgcccgctggtccgaccgcatcgcccgcgacctgctcgatgccggcctcgcccccgaagagcgggtcgggctcgatctgccgcgcggtgcggcgatggtcaccgggtttctcggcatcctgaaggccggcggcgcggtggtgccgctcgatcccgccctgccggccgcgcgccgggcgctgatcctggccgatgccggcgtgcgccgtgtcctgaccgacgcggccgagcccgagggtgcggatgtggcgccggttctggaacccgtcgatccgggccagatcgcctatgtgatccacacctccggctccacgggcatgcccaagggcgtcgccatcccgcaggatgccctctcggcccatctcgacgactacaccgcccgctatggcctgaccgatgccgatcgcgtgctgcaattctcgaccctcggcttcgatgccgccttcgagcagctgctgcccgtgctcgccgcgggcggcaccgccgtgctgcgcggccccgagatctgggaccatgccacgctgaacgcccggcttgcggccgatcgtgtgacgctcgcctatctgccgaccggctattggcgccgctggctcgacgatctgccggcgtcgctcccctgcctgcggctcatggtcgtgggtgcggaggcgctgggcggcgatgccgtcggcctctggcgcgccggcccgctcggccatgtggccctgcgcaacagctatggcccgaccgaggccaccatcaccgccaccgatcacgaaaccggcccgaccgacatcccgtcgccccaggtcgccatcggccgtccctggccttcgcgtctggccgtggtgctggatgctcatggcaatccggttccggtcggcggtgtcggcgaactctgcctgggcggtgtggcgctcgcccgcggctatctgaaccgcccgggcctcaccgccgaacggttcgtgccggccgcgggcggcgggcggctctatcgcaccggcgatctggtgcggccgcgcgccgatggcacgctcgatttcctcggccgcgccgacagccagatcaagctccgcggctatcggatcgagccgggcgaggtggaggccgccctccgccgtcagcccggcgtgcgcgatgccgtggtcgggctgatggctggccgtctggtcgcccatgtggcgggcacggccgatccggcagcgctcaccaccgccctcggcgccgatctgcccggctggatggtgccccaggcgatcctggtgctcgatgccctgccgctgaccccggccggcaagatcgaccgccgggcgctgccgtcacccacactcgcagaagttgcgggtgaggaagcaagaaccactaacgagacgctcctgctgaccatcgcccgcgcgctgctcggccgcagcgatctgggcgtcaccgatgatctgttcgcggccggggcggattcgatcctggtgctgcagctggtcgcccgcgcccgggccgccggcctcgtcctcacgccccgcgcggtgttcgactggccgcgcatcgaccgcctggccgccatggccgagaccggggccgccccggcgcttctgccgccgctgaccggcaccgatctgccgctcactccgattcaaagccgtttcgtcgcccgccatgccgaaccggtcagcccctggaaccaggcagtgctgctggagttggcggacgacatggggggcgacgacatcggggcgccggccatcgccaccgccctcggccggctggtcgccctgcatgatgcgctgcgcctgcggctgcggcgtgacgcggacggggtctggcgccagtggattgcggcggaagagggggcggagctgctcgtcgcccccgccgacccggccgatcttcatgcgatggtcgatccggttgatgggccggtgctgcgcgccgcgctgatcgcgggcagcccccggcggctgatgatcaccatccatcatctggcggtcgacggcgtttcgtggcgcatcctgctcgacgacctcgccaccctgctcggcgggggcgagccggccccggccacgacgccctggagccgctgggtggaggccctgccggcccgcgccgccgcggtgcaggaccaggccgatatctggcgccgccgtctcgccggggctatcccgaccttcagcccgcaccgtgccggccgccgtcggcgcgcggaattgatcgtcgatgccgcccaggcccgcgacgaggtgctgctggcggccctctcgcgcgccctcggtcgcccggcgctggtcgagatcgaaacccatggccgtgatctggcgggccccgacacgccgctcgaccgcacggtcggctggttcaccgccacacatccgatggttgtcactccccaggatgacgaccgggttctggttgcaggtctgcgcgctgcccgcatcggtctgccgccaggcggcgcggcccatgccctggtcgacgggctggacgacctgccgcgccccgatatcgccgtcaacaatctcggccgcttcgccgaaggcgcggggccgctgcgcctggtcaccgacatgatcggcgaccccagcggcggccacgcccccgaacatgccctggtgctcgatgccctgaccatcggtgaccggctgcatctgcgtttcgatgccgatgaggcggcgctcgacctggatcgatttgcggaacgctttgccgccgccctcgatgcgctcggccgcgcgggcctgcccgaagacgcctggcccgccacgcccatgcagcagggcatgatcttccatggcaggctggcccctgcagacgggctctatgtcaaccagctctgcctcgacctcgccggccggatcgatccggccgcgcttgaggcgtcgtggaacgcggccctcgcccgccaccccatcctgcgcagccgcttcgccgagaccggggacggcagcctgatccaaatcgtggaaccggaggcgcgccttcgcctgaactgcatcgacgtcgatgcagatggatattatatcgacgtcgatgcatccggtgacagatacatcgacgtcgatgcattcctccgggccgacgccgcccgcggtatcgacaccgccaccgcgccgctgatgcgtctgactctgctccgcggcgtccgggccgacacgctggtctggacctgccatcacgccatcaccgacggctggagttccgcccgcctgctcgccgaaatcgccggtctcgccgagatcgcgggcgcggggcagggcggcagctatcgcgactatgtcgtctgggcggccggccggccggtggatgccggctggtggcgggcgcgggcggcggcggtgaccgatccggtgctgctgctgccggcgctgggccggcccgaggccccggtgcccggtcgcgcctgccggaccacccggctcgatgccgcccggaccgccgcactcaaatctgccgccgccgcggccggcgtcacgctcgccaccctggttcagggggcctgggcgctgaccctcgcccggctgggcggccgcaaccaggtcgccttcggcgtcaccgtctcgggccgcccggccgatctgccgggggtggaggcgatccagggcccgttcctcgccagcctgccggtctgggtcgacctgcccggatcggcgccgctcgcgccctggctgcgggttctgcaatccgaaaccgtcgacctggccgggcatgcccataccggcctggcggagatcggccgcatcaccggcctgggcgccgaggggctgttcgacagcctgctggtggtcgagaactaccccctcgacccgcgcctgatggcccggggcttcggcgccccggtcaccgacgcccgcatggtcgagcgcacccacttccccctcgccctcgccgtcatccccgaggctggaaggtcgggggagggcgagtgcctggccctccgcttcgatcacgacgccacccgtctcgaccacctcaccatcgccgctctggccgaggggctggccgatctgctggggcagctggcggcggatattaaccaggatctgggcaatatcgcgctggccctgccgggtggcgatgccggtgggcaacgggacggggcaggcgatgccgccacccccttcacccccgtcctcacccccatctccgcgcatgccgcggccgatcccgaccggccggcggtcaccatgggcgacgaccggctgacccgcggcgcgctggaccggctgtcaaaccgcatcgcccgccatctcgcccgcgcgggcgtcgccaccgaccggctggtcggcctctgcctcgaccgctcgccggcgctggtggccggcgcgctcggcattctgaaggccggcggtgcctatgtgccgctcgatccggcctatccggccgagcggctggccggcattctcgacgatgccggccttcaggtggtcgtcaccgaccaggccaccgccgatgccctggccgatctcttcgccggccggaccctggtcctggtcgatgccgcggacgaagccgacgacagcccgctcaacacccccatccaccctgatcagctcgcctatgtcatctacacctccggctccaccggccggcccaagggggtgggtgtcacccatcgaaaccttgcccggttgctgacccggaccagccattggtacggcttcgggccggccgacgtctggccgctcttccattccttcgccttcgacgtgtcggtctgggaaatcttcggcgcgctcagcaccggcggccggctggtggtggtgccctggtggaccgcccgcgacgccaccgccttccacggcctgctcagggccgagcgggtcaccgtgctcaaccagacgccctcggccttcctgccgctgatgcaggccgacatggcggccagcgacaggttgaccgatctcagggtgatcgtctttgcgggcgaaaagctggaaccggcggggctggccgactggctggcctggcgtggcgacagcgcgccggtgctggtcaacatgtacggcatcaccgagaccacggtgcatgttacgtatcgcgaaaccaccgccgccgatgccacccgccagccgccgcgcagcctgatcggcgtgccgatccccgatctcagcctgcatgtggtcgatgccgatctgaacccgaccccggtctttggcaccggcgaattgctggtcggcgggccgggccttgcccgcggctatctgggccgcccggcgctgacggccgagcgcttcatccccgaccccttcggcgcgccggggggccggctctaccgctcgggcgatctggttcatctgatggccgacggcatgctcgactatgtcggccgcaacgatctccaggtcaagatccgcggcttccgcattgaattgggcgagatcaacgccgccctgctcacggcgcccggcattcgcgaggcggcggcgctggcggtggatgacggcgcgggggcgaagcgggtcctcgcctggctggtcatgcagccgggcgtcaccctcgatgcggcggcgctgcgcagccatctggccgcgcgcctggccccgcacatgatcccggccggcttcatcgccctcgaccgcatgccgctcaccgtcaacggcaagctcgatcgcgcgcgcctgccgatgaccatcgcccccgaagcggggtcggacgacggtccgggatacgaaaagccggccacggccaccgaggcggcactggcgcggatctgggccggtgtgctgggcctggcgcggctggggcgcaccgaggatccgttcctgaacggcgccgattccctgctcgccatgcgcacgctggcccgcatccgcagcgagttgggggccgatcccggcctcaaggcgctgttcgaccacccgacggtggcggaactcgcgaaaattgttgatgccgccaaagaacacgaccttgaggtgttgcctgcccgtgccgacaccagccgggcaccgctcgcccccggtcaggacgggctgtggttcctctggcagctcgacccggccagcaccgcctataccgtcgccggcgcgctgtcgctgcggggggcgggcgcggggaccgtcgacgccaccaccctgcgccgggcagttgccgatgtggtcgcgcgccacgaggcgctgcgggtgcgcttcgccgagactccgaccggccccgtgcagctgatcgaccccgcgccgcgtttcgtctggcaggagatcgacctcacggccgcgcccgaaaccctgcccgatctgctcgccggtttcgccgccgagcccttcgatctcaccgccggcccgctgcttcgtgcccggctggtcaggcttgcgcccgaccattgcgtgctggcgctcgccacccatcacatcgtggccgatggctggtcgatgacggttctggcgcgcgagattgcggccctctgtcagggccgcccgctgccggtgccggtctcgggctggggcgactggtcggcatccgcgcgcgcggcgctcgatcagggccgtctggccgatcagatcgcctggtggcaggctgaactcggccgggaccatccggttctgcggctgccggtcgaccgcccccgtaagggcgcccgcagcgatgccggcggccgggtcgaacgccggctcgatgccggggccatgggccgcatccgtgccgccggccgcggggccacgctcttcgtcaccctgctcgccgccttcgatatcctgctgcaccgccagggcggcgataccgacatccgcatcggcgtgcccgtcgccggccgcaccggcccgggcaccgaggacatggtcggcttcttcgtcaacaccctggtgttgaaggccgagatcaccggcggcatgcgcttcggcgatctggtcgatcagctccgccgtcgcagtcttgaggcctggtcacgccaggatgtgccttttgccgtgctggtcgatcggctgggtgcggagcgcagtctggaacgcacgccgctgttccaggtcatgttcaacctgcagcagcaggaccccgccgccgcggcgccgggcgaggggatagaggtggaggtggtcgaaaacccggtggccaccgcccgtttcgatctggtgctggatgtggtggagcggcccgacgggctgcggctcgccttcgactatgccgccgacatcttcgacgctgccaccattacgggtctggccgatcaatatctctacctgctggagcaggtcaccagcggtgccgatccgctgatcgccgccctggccctgccggcaccgcgccccgccgccctgccatcggccccgatccggcagcgcttcgacccggtcgcggaccggattctccgccgggccgcccgggttccggcccgcgaggccgtggcctgcgagggcataagggttacttatggtgatctggaccggctgtcgaaccgcatcgcggcggcgctgctcgcggccgggctgcggccggaagagcgggtcggcctgctgctgacccgcacggccgatctgccggcggcactggtcggcgtgctgcgcgcgggcggcgccttcgtgccgctcgaccccgcctatcccgaagaccgtctggccgacatggccgccgatgccggcatccgcctggtgctggccgatgctgcaaccgaagcgacgctgccgggcctgctggccggccggcaggtcatccggctcgacgcgctcccgaccggggggcagatggcgcccgtcctcgtccgggtccaccccgatcagctggcctatgtgatctacacctccggctccaccggccggcccaaaggtgtcgccatttcgcaggatgccttcagcctgcatctggacgatttcctcgccacctacggcattggcgacggtgatgtggtgctgcagcagtcgacgctcaatttcgacgttgcgcttcacgaaatgctgccggcgctgatcatgggcggccgcatcgtcatgcgtggtcccgccatgtgggatctggccgcgctcagccgggtgctggcggaagaacgggtcaccttctcgcgcattcccaccgcctattggcagcaatggctgcgcgatccgccgcgcgacctgccgcatctgcgccaggtcaccgtcggcggcgagggcctgcccggcgatgcgttgcgccgctggcaggaaggccccctcggccatatccggctcgacaacctgtacggccccaccgaaaccaccgtcgcctgcatgcaccgcatcacgaccccagaggatgcgggtgccctgatcgtgccgatcggcaccgcctatcccggccggacggtcgcgatcattgatgcggacggaaaccacgtacctgtcgggggttatggcgaactctgcatccagggtgacagcctggcccgcggttatctcggccgtcccggccagaccgccgaacgcttcgtgcccgacgagcaggcctgcaggcagggtgccccgggcgcgcgtctctaccgcaccggcgatctatgccgcatgcgccgggatggcacggtcgacttcctcggccggctcgacgcccaggtcaagctgcgcggcttccgcatcgagccgggcgagatcgaggccgcgatgcgggcctgcccgggcgtggaagatgccgttgtcgccctgatcggatcgggcgagggggcgcggcttgccggttacgtcaccggcacggccgaaccggccgtggtggcggccgcccttggccagcgcctgccggcccatatggtgccgaccaccatcaccccgcttgccgccctgccgctgatgcccaatggcaaggtcgaccgcaaggccctgccggtgcccgaacttgccgccgcgggcgagatcgtggcgccgggcaccgatgccgaggccgccctgctcgatgtgtggcgcggcgtgctggggcgtgaggatttcggcgtcaccgacggcttcttcgaactcggcggcgacagcattctcagccttcaggtcgtcgcccgcgcccgtgccgccggctgggtgatcacgccgacccagatcttcacccatccgcgcatcgaccgcctggccgcggtggccaccccggccgccgcccaggatattgcggccgaaatcaccggcacgcccctgccgctcacccctatccagcggggctttttcgaccgccatcccgatggtccgtcgcactggaaccaggcggtgctgctgatccccgacccgtcggtcacggccgaggcgctggccgcggcactcgccgccctggtcgcacgccatgacgcgctgcgcctgcgtttcgcggtcgatggggacggggcctggacccaacatgttgcgcccgctgaaacagtggagctgctgatctgccgcaccaccacccgggatggcctggaagacgcctgcaccgatgtgcaagccagtctcgacatccggactggtcccatgctccgcgccggccttttcgagctgcccggcggcgcgcggcgcctgctgatcgccatccatcatctggcggtcgacggcgtctcttggcggattctgggggctgatctggagacggcactttcgggtgcaccgctcgcccccgtgcccatgccctggagccgctgggtctccgaccgcgccgccctggccgcaaccccggcactcgcagaccaggcggcctggtggcgccaggcggcagagggcgccgaaccctgcttccccgaccgcacgggtccccgcggcctgacgcagagctggcaggccgacccggcgctcacggcggccctgatccacgacctgccccgccgctatgggctgggcgtcgaagatctgctgaccacaaccctcgcgcgcctgctcgccaccaccaccggccgcacccacatcgggatcgatctggaaggccatggccgcgacacggacgccgccgatgccgggcctgctgccgacctctcccgcaccatcggctggttcaccgcccgctataccctggcgctgccgggggcgggcgataccgccgacatcctcgccgccacccgccagacgctgaaatcggtgccccatggcgggcgcgaccggggctggatcaccgccctggatgatctgccgcgggccgatgtcagcctcaactatctgggccgggtcgatctgggccttgccgggaacggtcgcgtcgcgctcgccccggaaggcaccggccggcgcgtggcgccgggtaccgagggcagcggtcatgcgcttgccgccgatgcgctgatccgcgacggccggctggtgatcgactggcggtccgacggtgcgcttgccgacggcgcagcgctccacagcctggccgagcatttcggcacgctgctggccgggctggttgaaacctgccgcaccacgcccccggttctggtgccggccgatgtgccgctggccgggctgggcgcggcggccctggcgcggcttgggctcagccttggcacgaccgaggatgtctaccccgcaaccggcttgcaggaagggcttctgcttcatgccggtgaggccaatgacggcctgtatatcaaccagttgtacctggttcttgaccctgaaacggatatcgaggcgctggttcaggcctggcgggccgccatgcgccggcatgcgatcctgcgcacccgcttcgcctgggatcatggcggcgcggcgctgcagatcgtgatgcgcgatgccgtgctgccggtcgcgcgtctcgattggcggaacctggatgccgccggtcacgaccgccgcctggccgcctgggccgccgaagaccgtcgccgcggcatcgatcccgccgtggcgccgctcgcccggttgaccctgatcgcacgccccgatggcggccacgacctgttctggaccagccatcatgccttgagcgacggctggagcctggccctgctgatgggcgagatcgccgccgattatgccgcccgcatcgatggcacagaggcgggtctgccgccggtccgcccctggcgcgaccatgtcgccgccaccctggatgccggccgccgcttcgcctcctggtggcaggcggaagccgcgcgccgggacgatccggcccggctgctgccgctgttgaccgcgcccaccgtaccggccggggaggccgccgccggggccttcacccgccacaccccgctgggtgaggccgccaccgcgcgcctcgccgccgcggcggcgcaggccggcgtcaccctcgccacactggtcgaggccgcctgggcgctgaccctcggccgtctcggccaccggaaccaggcggtgttcggtgtcaccatgtcgggccgcggcggggatctggccggcatcgaccggatgatcggcctgttcatcaacagtctgccgctcgtggtggatttgcccggcgcgatgccggtcaaccaatggctgcagaacatccagaccgccgccgccagcctccgcgccgccgaggcaacaccgctcgccaccgtccagcgtctcaccgggctggccggcgatgccctgttcgacagcctgctggtgttcgaaaactaccccgtcgacggcgccctggccgacagccggctggggcggctggtgcgtcatgtggcgatggtcgaacgcacccattacgcggccacgctcgccgccgtgccgggcagcacgctcgatctgcgctggggcttcgacggtgcccgcgtttcgccatccgatgcggatcgcctggccgcgcgcttcctcgaccttctgaccgcgctgcccgaccatctcgaccggccgctcggcagcctcgcctggccggccgatccggtgccgcaggcggcggcgcagcccttccgcgccgtcaccgcccgcctcgccgccgcggcggccgcacaccccaatgccatcgccgtcacctgcgagggcgtgtcgatcacccatgccgcgctggatcgccatgcgaaccaggtggcggggcgggtggcagatgccggcggcacccccgacctcaccgacacccccatcggcctctgcgtcagccgcgggccggccctggtggccgggctggtcggcattgtgaaggccggtgccgtggcggtgccgctggatggcgatctgcccgatgcgcgtctggcgcagatcatcgccggggccggcctgtcgctggtcgtcgccgatgccgccggccgcgatcgtctcgccggcttcggcctgaccatcatttccgccgacgagggcggcgacgcggcaccggcggtcgatgccgtccgccacccccaggcgctcgcctatctgctctacacctccggatcgaccggcacgcccaaaggtgtcgccattccccatggtgccctggccgcgcatctggatgaccacgcggcacgcttcggcctcaccgccgatgatcgcgtgctgcagttctcgaccctcgccttcgatgccgcctttgaacagctgctgccgatcctgtcgctgggcggcacggtggtgatgcgcggccccgatctttgggactatgccacgctgaatcatcggcttgccgccgaccgcgtcaccgtggcctatctgccgaccggctattggcggggctggctcgccgccctgcccgaggtggcgcccgcatctctgcgcatgctggcggtcggcgccgaagccctggggggagcggcgctcgggcgctggcggggcgggccgctcggccatctgccgctgctcaacacctatgggccgaccgaggccaccatcaccgcgacctgccatctgaccggggccgccgacatcgccgccgcccaggtgccgatcggccgggcctggccgtcgcggcgggtgctgatcctcgacacccatggcaaccccgtgcctgaaggtggcatcggtgagttgtgcatcggcggcccggcactcgcccgcggctatatggcccggcccggccagaccgcggagcgcttcgtgcccgatgcgaccggcggcccgggcgcgcggctctatcgcaccggcgatctctgccggcgcgaagccggcgatgtgttccgctatctgggacgcatcgacgatcaggtgaagctccgcggctatcggatcgaaccggccgagatcgaggcccggatccgcgccgtgcccggcatccgcgatgccgcggtcggcgtgatcgggcagggggaggccgcgcgcctcgttgcccatatcgtgggcgaggccggccccgaaaccgtgcgcgccgctcttgcccgcgacctgccgggctggatggtgccgcaggcgatcctgccgctcgatgccctgccgctgacgcctgcgggcaagctcgaccggcgcgccctgccggccccggcggccgatcttccgacgcatcgggcgcccgaaagcccggccgaacgcatgatggccgggctctggtcggccgtgctcggcattgaaaatcccggcgtcaccgacgactggttcgccctcggcggcgattcgatccaaagcctgcaactggtcgcccgcgcccgcgcggcggggctgaagctcaccacccgccagatcctggaacatccacgcatcgccgatctggcccggctggccgttccgatcagcgaagccaatgatctcccggcggccccggctaccgaccccttcgcggccgtccgccaggtcttcgccgagctgggcgagcctttcgacgcggtcgaagacgtctatcccgccaccccgctgcaacagggcctgctgttccacgcccgcaccggcgcccgcgacgggctttacgtcaaccagctgcgcatcaccatcgacggcccggtcgaccgtaccgcgctggccgatgcctggcaggcggccgtcgcccgccatccgatcctgcgcacgcgtttcgaatggcggcatggcggcgaggctttgcaggtcgtccagcgcagcgccaccgccctggtgaccgaagaggatcacggcctcactcacatcgccgcgcatgatgcccggctcagggcctggcgggcggaagatctggcccgcggcttcgatctcacccgtgcgccgctggcccggctcgccatcctggcccgccccgatggcggcaacgatttgatctggaccgcccatcacgtcatcaccgatggctggagcaccgcgcgtctgctggccgaaatcgccaccgactatgccgcccgccaggccggcggtgcggccgatattccggcgccgcggccctggcgcgactatgtcgcctgggcggccgcccgccccgatgcggcggcgtggtggcaggcgcaggcggcgcggctggccgatccggtgacgctggcgaccgccttcggcgacgtcaccccggccgagccggatacaaccgatgatatctcgatcagccttggagacaatctgtcggacgctctgcgccgtctcgcccggcggaatggcgtgacgctggccagcgtgatgcaaggcgcctgggccctgctgctggcccgcgcgggcggcggccgtcaggcgctgttcggcatcaccaccgccggccggccgcccgaactcgacggggtcgaggccatgcaggggccgttcatcaacagcctgccgctgctggtcgacatcgccccgggccggacgctcggcgcctggctgcgcgatctccacgcgctcggcggcgcgctgcgcgaggttgaacacaccccgcttgcccgggttcagcgctggatggggcggagcggcgacgcgctgttcgacagcctgctggtgttcgaaaactaccccgccgaccgcgcgctgggcgacaccgccttcggcggccgcatcgccggggtcgagaccaccgagcgcacccattacccgctgacactcgccatcgcgcccgatgccgccatcacgctgggtttcggcttcgatccggcacggctgcccgccgatctggtggcacgtatcgccggcctctatcgcgacctgctcgcccgcatggcggaagcgcccgacgatctggcgctcggcgcgctccgcctcaccgatcagggcatgcccgtggtcaacgcccccgcaaccccggatgtcgtcacacgcatcgccgcccgcatcgccgccacccccaccgccatcgcgctccgcgcgggcggggagggccgcgactatgccgcgctcggcctccaggccggcgggatcgcccggcgcctgaccggagaggcggccgtgctgccgcccgacacctccatcggtctctgcgttgcccgcgggccggatctcgcggccggcttcctgggcattctggcggcgggcggagcggtgctggcgcttgatccggatctgccggatgcccggctgcgtctcatgctggaagatgccggcgtgacccgggtggtggtcgatgccatgggccgcgcgcgcctggccggcttcgcccgcgatctgaccctgatcgatgtcgcgggcgcgggcgcgccgctggcggcgccccatctccaccccggccagatcgcctacctgatctacacctcgggctccaccggtcggcccaagccggttgcggtttcgcatggcgcgcttgcggtccatgtcgacgactacatcgtcgaatatgggctgaccgcagatgatcgcgtgcttcaggtctcgaccttcggcttcgatgccgcgatcgagcagctgctgcccgcgctcaccagtcggggcaagggtggtgatgcgcggccccgccctctggtcggcggaggagatcaccgccgaactggccgacgaggcggtgaccgtcgtctatctgcccaccggctattggcggatgtggcaggcggggctgggtcgggtgcatctcccggcactccgcctggtcaccaccggcggcgaggcgctggccggggcggcgctggccgactggctggcgagccccctgggccatgtgcccttcctgaacagctatggcccgaccgaggcgaccatcacggtgtcggcccaccgcagccgggccgccgatgccctgctgccggtggtgccgatcggcgaggcctggggcgggcgcagcctggtggtgctcgataccgagggcgacccggttccggaaggcggaaccggtgaactctgcatcggcggcccggcgctggcccgcggctatcccggccggccggggctcaccgccgagcgcttcgtgccggccccgggcggcgggcggctctatcgcaccggcgatctggcccggctgggccccgacggcgcgatccgcttcctgggccgcatggacgggcagatcaagctccgcggcttccgcatcgagccgggcgagatcgaagccgcgctccgcaacgaggccggcatccgggacgccgtggtcgtcctggcggggcaggatgcgaccgcgcgcctcatcgcctatgtcaccggcacggccgatcccgaccggctgaaacaggcgctggcccatcgtctgcccgggcatatggtgccgcaggtgatcatggtgctggatgcgctgccgctgacgccggccggcaagctcgaccgcaaggccctgccggccgcggatgcgccccaggcgctgccggtcacgctgccgcgggacgagatggaggccgcactgctcgatctctggcgcggcctgctggggcgtgctgatttcggcatcgacgacgacgtcttcgacctcggcgccgattcgatcctcagcctgcagctggtctcgcgcgcccgccgtgtcgggctggtgctgaccccggctcaggtctttgagcatccccgcattcgcgacctcgcggccgcagccgcccgcatcggcggggcgggtgccaccagcctgccgggccagggcgaaatcatcggccgggccctgccgctcacccccatccaggccgatttcttcgagacctatccccagggcccgtcgcactggaaccagtcggtgctgctgaccgtcgacggatccatcgagcccgaacgtctccgcgacgcgctcgatgccctggtcgccgcccaggatgccctgcgcctgcgcttccgcaccgatggcgagggccgctggacccaggccgttgcgccagacgagacggcggagctgctccgggtgatgacgatcggcgacgacccggccgatctggaccgggcgggcgaggcgatccaggcctcgctcgacatccgcagcggcccgctgatccgcgccgggctgttccgccgcccgtcgggcgaccggctgttgatcgccatccaccatctggcggtcgacggggtgtcgtggcggatcctgcttgaagatctggcccgcagcaccgccacccgcccggttctgccctggagccgctgggtggaggcccagaccgcctatgccgcggggccggcggtcgcggccgaactcccctggtggcaggcggctttggcccaggccgcaccggccttccccgccgcccgcagcggcgatcgccgccagcatgaccagatcttcgatgccgccctcaccacccgcctgatcacccagctgccgcgccgctggcggatcggcgtcgacgaggtgctgctcgccgcactggccgccagcctcgccgcggaaggttcgcaactgttggtgtctcttgaaggccatggtcgcgaagaggttgtggaaggcgcggatctcagccgcaccatcggctggttcaccacccggttcccggtggtcgtgccggtgagggaggatccgggtgacctgctcgccggggtcagatccgccctgcggtcggtgccggtcaaggggctgaactggggctggctgcgccatggcgccgatccggcgctggccgccgccgcccgcgcgctgcccgcgcccgatatcggcttcaactatctgggccggttcggtgaagggcaggccggtgagggtggtttcggcttctcgcgagaggcggccggccgctcggtgggcgtggagacgccggcgggcctggcgctcgacgtgaatgcgatggtggtcggcggccggctctcggtctcgtggcgtcacgataccggcgcgctcgcccccgaccggctggcggtgctgaccgaaggcttcgcagagcgtctcgccgccctcatcgaccacgcccttgccaacgagatgcgggccaccccgcaggatttcgacatcgatatcgaccaggacgcgctcgacgacctgctcgcggagatcgacggatgaccatggacagccatcaccgccacgacgacgcgccggaagcgaccccggccgccccggtcgcatctttccgcgacaagagtaacgtggccgagatcttctatctgtccgagttgcagcagggcatgctcgcccatgcgctgaagggcggcgacgacgcctaccacatccgccatgtcttcgaaatcgccgggaatttcgatcccgagcgcttcgcccgggcctggggggcggtggtcgcccgtcatgccctgctccgcgccgatatccgctggcgcgagatcccgaagccggtacatatcgtctatcgccgcaccgccggttcgctcgccatggccgactggcgcggcctcgacccggcggcgcagcgggcgcggctggaggccgatctggccaccgcccgcgcggccgggttcgatttcgcccgcgccgccgatccagccgtgcagctgatccgcatcgccgatgaccgctggtggttcacctggcgcttccaccatgtccagctggatggctggagcgtcgcccgcatcctggccgacctgctcgccgcctatcggggggaggcgcccgccgcccccgcgccctcgttccgcagccacatcaaatggctggaggggcgcgacctcgccgccgccgacgcctggtggcaggcggagctggcgaccgtcgaggccgcaaccccgctgcccccggcagaggggccgttcagccagggccatgccgagcgcatccgccatctggatgccgacaccaccgccgccctcgaccggctggcccggcgcgccggggcgacgctctcgaccctgcttcaggccgcctggggctggctgctcgccacccatgccggcaccgacgaggcgctgttcggcgtcaccctctcgggccggccggcggacctcgacggggtggagcagatcgccggcctcttcatcaacaccctgccgctgcgcgtcacccttgatcgcagtctcaatgtcaccgactggctggcggcagcccagcgtcggatgaacgcgctccgcccccacgaccatgtgccgcttgcccgcatccgcggcctggcgccgctggtcgacggcccgcttttcgacaccatcctggtggtcgaaaacttcccggtcgatgctgccctcggtgcggcggatgatgatgtcaccatccgcgtgcccggaccggccgcacccgaagacggcgtcatcgccaccgatggccgcaatcactacccgctcagcctgatcgccgaaaccggtccgcggctgaaactggttctggcctataatctcagccgttatggccatgacgatatcgcccggctgatggcgcagctggtgcgggtgctggaagcgctgcccgtcgccgccgaccggccgctcggctgcttcgcccccttcgacgacatgccccgccagcctctgccggcgctgccgcagctgctgcccgaccatctgcgggcccatgacccggcggccgtcgccatcgtcgacggcgcccgcgccatcacctatggcgacctcgcccgcgatgccgcgcggcttgccttccggctcggcgcgctcggggtcaggcccggcgaccgggtggcgctgatcgcgccgcgctcggccggcttcgttgcggcggttccaggcatctggcgggcgggtgccgcctatgtgccgctcgaccccgcagcaccggcggcccggctcgccgatcagatcgccgattgcggcgcccgcctggtgatcggccgggatggcgacctgccggctgatccggcggggtggggcgaggacgaggccccggccgtggcgctcgacccggcctgcgaggcctatgtcatcttcacctccggctctaccggccggcccaagggcatcgccgtctcgcatggcgcgctcgccgcctatctggacgggctggtggcgcggctgtcgatgggccgcgacccgctccgcatcggctgggtgtcgacgccggccgcggatctgggccataccgcgctgttcggcgcgctgcgcctgggcgccgaactccatatcgccgacgaggcgcggatcttcgatcccgaccggttcggcgcctggatggccgatcacgccatcgatctgatcaagatcgtgcccggccatctggcggcgctgctggacgcggcagagcccgcccgcgtgctgccccgccgggcgctggtgctgggcggagaggcgctgaccgccgggctcgccgcccgcatcgccgagcttgcccccgcctgccggttgatcaatcattacggccccagcgaaaccaccgtgggcgtgctcaccgacgagggcggcacggccaatgccggccgccacgccctgggccgcccgctcggccatgccgcggtccgcatcctcgaccgcgccggcaacccggtcgccccgggcatggccggcgaaatcgtcatcggcggcgcaacgctcgcccatggttatgtcggccgtcccggccagacggcggagcgcttcatccccgatgccgccggcctgcccggcgcgcgggtctatctgaccggcgatcgcggccgcgcgcgcgaagacggccggatcgacttcctgggccggctggacgatcaggtcaagatccgcggctatcgcgttgaaccggaagaggttgcaaccgtgctccgcggcctgcccggcgtcgcggccgcaactgtgatcgcccgccccgatgccaatggccggctgcggcttctgggctatgcggccgggtccggcctcgacggcgcccggctgcgccaggccctggccgaacgcctgcccgatgcgctggtgccggcggcggtgatggtgctggaccgcctgccgctcacccccaacggcaagatcgaccgcaaggcgctgcccgacgagccgggcgccgaggcggcggccgccccggcgaaaccggccccccgtaccgccaccgaagccgcccttcttgccatctggtgccaggtgctgaagcgcgacgatatcggcgtcaccgacaattttttcgcaagcggcggcgattcgatcctcagccttcagctggtcgcccgggcccgcaaggccgggctgaagctcacccccaaacaggtcttcgaccagcccgagattgcccgtctggcggcgctgatcgacggcgcgacgccggccgccaccccggctccgacggccaggccccaggctccgcgcctgccggcggcgcaggtcgcggccctcgaagccctgcgccagagtggggtgggccaaagcctggacggcgtgaccgacatcctgcccgccacccccgtgcagcggggcatgatcttccacacgctggaggcggcgggccgggcggacggggcgggcgtctatgtcaaccagctgcgcctcaccttccgaggccgcgtcgacctcgaagcgctggaggccgcctgggcggcggcgatcgcgcgccatccggccctgcgcacccggtttgaatggcgccatggcggtgatctgctccagatcgtgcatgaagcggccgcggcgccgatcgccgtgctcgactggtcgtctttgccggcggccgcggcccggctggaggactggctggccggtgatatcgcccgcggcatcgatctgacccgcgccccggcgatgcgccttgccgtgatccgccgccccgatggcggcgacgagctggtctggaccaaccaccacgccatcaccgacggctggagcaccagcctggttctggccgagcttgcccgcgactatgccgcacggctggagggcggcagcgccgggctgccggcaccaccccacacgcgcgcctatgccgcctggctcgccgcccagcccgaccccgaaccctggtggcgccgccagatcgcccgcatcgaccagccggcccgaatcaccgaagccctgatcaccgaagcgctggcggcccctgcggaggccaccccccgccaccaccagctgcgtgtcctgctcgaccccgacatcaccgggcgcctcaccgcggcggcgcggcgcgaacaggtcaccctcaacaccctggttcagggcgcctgggcactgctgctcggtcgctatggcggccgcgatcaggccgtgttcggcgtcaccctcgccggccgtccggcagagctgccgggcgtcgaggccatggccggggcgttcctcaacactttgccggtctggatcgacctgcccgccgatgccgccatcggcccctggctgcgcgacattcaaaagttgaacgcagaactccgttcagttgaattttccagcctggccgatgtccagcgctggtcgggcctggcgggcgaggggctgttcgatgccctgctggtcttccagaacttcccggtcgaggcggcgctggccgatctggaaacccggctgggcgtcaccggcgccgatgcctggacccgcagccattacccgctggagctgatggtggtgccgggtgaccggctggacctgcgctggaaccatgatgcggcccgcctcggcgacgcgcaggtggcacagctgcaccgccatttcctgcgcctgctcgaccttttggcggagggggagggcgtgttgggccgcatcgatatgctcgacgccgacgattgcgccgaactggtcctggcccgcaaccgcaccgccgaagcctgggacctggattgccgcatccacgacctcatcgcgccctggatcgtccgcagccccgatgcccccgcggtgatcgccgccgatggtcgggtgctggaccatgccgggctggatgccgccgccaaccggctggcccatcgccttcaggccgccggcaccggagccgacgacgtggtcggcctctgcctgccgcgcgggcccgaggcggtgatcgccatgctggcggtgatgaaggcgggcggcgcctggctgccgctcgatccggccctgcccgacgaccgcctggcctatatggtcaagaccgcgggtgcccggctggtgatcgccccggccgcggccgcggcccgcttccccgcccttgcggtcctcccgcccgatggcggcgaccatccgtcgacgccgccggtctgcccggccacccccgacacgctcgcctatgtcatcttcacctccggctccaccggccggcccaagggggtgatgatcccgcatcgcggggcggtgaactatctgcgctatggcgctgcggcctatatggatgcggacacggcggaacccggccgggcggcgggtgcaggcgcgccggtcaataccgcgctcggcttcgatgccaccatcaccagcctgttcctgccgctggtcaccggccgcgcggtccatcttctgcccgagacggatgagatcgaggccctggccgcccttctctcaggctctcatgacttcagcctggtcaagctgacccccgcccatgtcgaggcgctgaaccatctgaacccggccggcgcctatgccggccaggcccgcgccctgatcatcggcggcgaggcgctgaccgccgccgcggtggccccctggctggccgaggcgcccgccacccggctgatcaatgaatacggccccaccgaaaccgtggtcggctgcgccgtgcatcgggtgaccgcggccgatcttgccggcgagaccatgccgatcggccggccgatcgccaatacccgcctgctggtgctggatgatgacctgcgcccgctgcccgacggcgcggcaggggggctctatatcggcggggcggggcttgcccgcggctatgcgggccgcccggggctgacggcggagcgcttcctgcccgaccccttccacccgggtgaacgcctctaccgcaccggcgatctcgcccgctggcgcgccgatggcagcctcgactatctgggccggctggacgatcaggtgaagatccgcggccaccgcatcgaaccgggtgagatccaggcggtgctggccgcccatccggccgtcgcccgcgccgctgtgatcgcgcgcccgggcccggcgggtggcctgcgtctgctcgcctatgccgtcgcgacggcgggcgaagccgccgatccggcggcgctgctcgcccatctctcggcgcggctgccgcattacatggtgccggcgcaggtcatgctgctggacgatctgccgctgacggccaacggcaagctcgaccgccgggcgctgcccgatcccgaccggccggcagggcagggtatcgccgccggcgacccgctcgaagccgccctgctcgacatctggcagggggtgctgaaccgccgcgacatcggcgtcaccgacgatttcttcgacctcggcggcgattcgatcatgagcctgcaggtggtcgcccgcgccgcccgcgccggcatccgcatcactgcccgccagatcttcgatcatccgcgcatcgaccgcctggccgcggcggcccgcagcgccgaagccgaagccgccgaggccgaaatcgccgacacgcccctgccgctcacccccatccaggcctggttcttcgaccgccaccccgatggtcccggccattggaaccagtcggtgctgctgcggtcgcgggaggcgatcgacatcgccgccctcgaccgggcgctgaaggcgatcgtcgcccgtcatgatgccctgcgcctgcggttcgaaaccgatgtcgccgggcgctggcggcagcgtgtggccgagatcgagactgccgatctgctccgcgtcgcccgtctcgacggccccgacgccctcgatgcggcgggcgatgcggtgcaggccagcctcgacatccggaccggtccgctgctccgcgccggctgtttcagcctgccgccccgcggtaccgaacccgggagtgatcgcctgctgatcgccatccaccatctggcggtcgacggcgtgtcgtggcgcatcctgctcgatgatcttcaggccgcctatgatgccgcactggccggccggccgatcgatctgccggcgccgcccgtgccctggagccgccatgtcctgcgccaggccgcccgcctggaggataccgccgcactcggtgccgaactccgctggtggcagggccatctggccggcgccgcgccggtctgggggccggcccggtccggcgaccggctggaacaggaacgggtggtggccgaagccgtcacccgccgcctgctcaccgatgtgccgcgccgctaccggatcacggtcgaagaggtgctgctggccagccttgcccgcacgctcggccaggccaccggccgccacaccgtgctggtggcgatggaaggccatggccgcggcgagcccggagagggcggggaggcgcacgacctctcgcgcaccatcggctggttcaccacccattacgaccttgccctgccggccgggagcgatgagggcggggccgacgatgcccgcctgctggccgatctgcgcagccgcctgcgcagcctgccggcgcgcggtgccgatcgtggcctgctggcgctggcggcggaccccgcgatcgtcgaagccgcccgggcgctgccggcggccgatatcgggttcaactggctcggccggttcgacggcagcctggaggagggcgggcggttcgcgctcggcaccgaaaccgccggccgcaatatcggccgccgcggcccgatgcgccatgcgatcgagatcaatgccgcggtcaccgacggccggttgcgcatcggctggcgccatgatccggccgtcgtcgccgaagcggtcatgacccggatcgtcgagggtttcgaggcggccttgaccgacctcgtcagccattgcctgacggcggacccgatcccggtcgccgccgatttcccgctggcagccctcgatgaggacgggttcaaccgccttcagctggcgccgggccagacggaggacatctaccccgccacccccgtgcagcagggcctgctcttccacagcctgcgccatccggggcagggggtctatgtcaaccagctgcgcgtcaccctggacggcacgcccgatatcgacgcgctgggccgggccttcgccgcggcgatgacccgccatccggtgttgcggaccagtttcgactggcgtcatggcggcactgcgctgcaactggtccatcgccgcgtcaccctgccgatcgatgtgcatgactggtcgggccgcgtggcttacgagccggacctggccgactggcttgcggcagaccgcgcctgggggttcgacccgtccgcggcgccgctgatgcggctcgccctgttccgccgccccgacggtgcgcatgatctggtctggaccctgcaccacgctttgaccgacgggtggagcaccgcgcgcctgctccacgagatcgcccgagattacgaggccctgaccgagcccgagcccgccgaggccggcattcaggcccccaccccctatcgtgactatatcgcctggctgctccgtcagcccgatccggccccctggtggcgggcgcaggcggcgcgcatcgccgatccggccggcatcacccaggttctggccgcgcctgcggcgccggtcgccggttcccatcgcctggaccgcccggcccccgaagccctgacccgtgccgtggaggcgctggcgcggcgggagcgggtgacgctcgcgaccgtgcttcagggcgcctgggcgctgctgctcggccgcatggccgggcggggccaggcggggttcggcctgaccgtctcgggccgcccggccgatctgccgggggtggagcgcatggccgggccgttcatcaacagcctgccgctctggatcgacctgccccccgccgcccgtctgggcgactggctgcgcgacatccaaaagttgaacgtggaaatgcgcgcggttgaacacagcagcctcgccgacatccagcgcctgaccggccgctcgggtgacgggctgttcgacagcctgctggtgatcgagagctatccggtcgaaaccgccgccggtgccacccgtctcggcgcccgcacccgcgccatgtcgatggtggaacgcacccattacccgctggtgctggcggccctgcccggtgcccggctggatcggcccggagccgcgctcgatctgcgctggggctgggatggcgcgcggctcgacggcgatgcggtggcgcgtctggccgatgatttcctcgacctgctcggcgccttcaccgccccggacgccgggcggctgccgctgggtgcggtgtccgtcacggcccccgtgccggccccggcggtcgtccacgacgtccaccccgtccatgaacgcttcgccgccatcgccgcccgcatgcccgaccgcgaggcggtggcctgtggcgaccggcgcctcgactacggccagctcgaccgctggtccagccgcatcgcccgcgcgttgctggcggcgggggtgcagcctgaaacccggatcggccttgcggtcgaacgctcggtcgggctggtcgccgccattctgggcgcgctgcgctcgggcggggcttacgtgccgctcgatcccgactatccggccgaccggctgcgccacatgatcgccgatgccggcctcaccgtcctgctggtcggccccgaggcggcacgaatgctcgcacaggttgtggatacgattcctgatagttgcaggctgatcgacgtcacgaccctggatgacctcgacgcccccgactcccttgatgacggcccggtgacggtgccggtcctgcccgaccagctcgcctatgtcatctacacctcgggctccacggggctgcccaagggggtcggcatctcccatgccgcgctcagccgtcatttcgacgatttcatccccgctttcgcctatgggccagaggatgccgggctgcagttctcgacggtcaatttcgatgccgcgatcgaacagatgctgccgctgctcaccctcggcggccgggtggtgctgcgcgggcccgagatgtggtcggcggaggagctgacccgcgtgctggcgacggaacgcctgaccatcgccgacatcccgaccgggttctggcagcactgggcgcgcgacccgtcgcttcacctgccgcatctgcgccgggtgacggtgggtggcgaggcgctgccgcccgatgcgctggcgcgctggaaggccggccccctggcgcatgtccggctcgacaaccgctatggcccgaccgaagccgccatttcggcgctctatcacgaaacccgcgccgaagacggcgcccggccgccggtgccgatcggccgcacctatcccggccgcagcgccgtcatcctcggcaccgacggcaatcccgtgccgaccggcggcatcggtgaactctgcattggcggcgctgcgctggcccgcggctatctgaaccgccccggccagacggcggagcgtttcgtgccggatcccttcggggcgccgggcgcgcggctctaccgcagcggcgatctctgccggctgcgcgaggatggggtggtggtcttcctcggccgcgtcgacgcccaggtcaagctgcgcggcttccggatcgagccgggcgagatcgaggcgctgctcagggcgcgccccggcgtcagtgatgccgtcgtggcggtgcggggcgatcgcctgctcgcatgggttgcggctgacgcggaaattgacccgatggagttgcgggctgatctggcgggccaactgcccggctggatggtgccgcagcgggtcatccgcctcgacgccctgccgcttcagccctcgggcaagatcgaccttgcagcgctgcccgaacccgaaaccgcgtccgaggcggtggcgccgcgcaatgcgctggaagcccgcctgctcggcctctggcagaaggtgctcgcctcggacgggccgggcgtcaccgacgacttcttcgccgttggcggcgattcgctgaaggcgctgcgtctggctgccgccgcccgtgccgagggtctggacggcctctctcttgaagcgctgttcgagacgccgaccgtcgccggcctggcccgccgcctggcccgagaggcggacgagaccacgccgcccgaggccacaccgcccgctggcctccgctgcctcaacggcccggcgccgcagcgtctgttctgcatccatccggggtacgggctggtgcgcgaataccgccacctcgccgcggccctggacggccgggtcgaggtctggggccttcaggcaccgcgcctctccgatcctgcctgggcaccggccgacatggcggcactcgcccgcgactatctggcccggctgcgccttgtgcagcccgaaggcggcctgcacctcgccggctggtcgctcggcggctggctcgccgcggcgatcgcggccgaagccgaccgggaaggcgggcagggcgccacaacccttaccatcatcgatacgccatcaaccgtgccttcagttgtgttcgatccggccggcaccgaggcccgcatccgcggctatctcgcggccgggcagatcgacgacctggccgccgaagccgctgcgggcacgggggcggatgaccgcgacaccctggtcgccgccgccgtcgacctggtcggcctgcatgcccggctgctcaccggctgggtgctgccgcgcctggcggtgccggtcagcctgctccgcgccaccgccgccggccgcgcactcgaccccgccggctggcacgccgccgccccggcgggcctcaccctccacgacctcgacgccgaccacgagggcatcctcgcccatcccgacacagcggccctggtgctgcacaccgtcacccaagccaccccgggagcccccgcatgaccgtgacaaccctgcccacccgcttcgtgccggaggtcatggtcacccccggcccggccgcggacgaggcgacgctgcgtctcgatgccgtcaccgaccctgccgccctgctcgacggggcggcggccctgctcggccggctctccgcccgtcatcccgccgccaccaccctggttctggccggggcggggtgggcggcggtggcggcgggcttgcgcgcccgcggcctggcactccgcgaccctgccggccggctggtgctgccggtcgatctgctctggcaacagccggcggcctgggcgcctcaggtgccgccggtgccctatccctaccgcccggtgctctcgggcgccttccgccacccgcagcgcccgcccaagccccatggcgaactctaccgccgcttcgtgccctggctcggcctcgacatctcgttccgcgccgccagccttgaggccgatctcgatctggtacaccgctggatgaacgatccgcgcgtcgccgcgatctgggaagaggcggggccgatcgaccatcaccgggcttatctctcagggctgatcgccgacccgcacatgatcccgatgatcggctgtttcggcgacgagcccttcggctatttcgagatttactgggcgaaagagaaccgcatcgcgcccttctacgatgcgcaggatcatgatcgcggctggcatgtgctggtcggcgacgacaggttccgcggccggcagtatgtcgccgcctggctgccctcgctgatgcattacctgtttctcgacgacccgcgcaccacgcgcattgtgggtgaaccgcggtctgatcacagccaacagttgcgtaacctcgatcgcggcggctttgctcggatcaaggatttcgatttcccccacaagcgcgccaccctggtgatgctgctgcgcgagcggtttttcggcgaccggctctggctgcccgatttcgcgaccgcaagccccgacagctgggccgccgccgccaccacccccgaaccgaggacgatcgcccgatgatcatcgacgacacggtctccatgctcgatgtggccggcatcggcttcggcccgtccaatctggcgctggccatcgcgctcgatgcccgcgcccccggccgccggtcctgcttcttcgaaaaacagccggaattccgctggcatggcggcatgctgctgcccggcagccggatgcaggtctcgttcctgaaggatctggtcacgctgcacgaccccaccagccgcttcaccttcgtgaactatctccatgcccgcggccggctggtcgacttcatcaatcagaagacctttttccccagccggatcgagttcaacgactatctccgctgggcggcggcgcagttcgacgaccgggccagctacggaacggaagttgtcgcggtcgagccggttacaaccaatggtcgtctgaccgcctttgcgatccgcatcgccgatgccgcggggcgcgagcgggtggtgcgggcgcggtccgccgtcgtcgccatgggcggccggccgcgcatccccgagcccttccgtccgctgaagagggagccgcgcctgttccattcctcgggctatctgcgccatctggaccggatccgcctcgccgacgaggccggcggccgggtggcggtgatcggcggcgggcagagtgcggccgagatcttttcggatatacgcagccggtttccgcgcgtaaaagtcgatctgatcctccgcgccgcggcgctcaaacccgccgatgacagcccgttcgtgaacgagatcttcaaccccggcttcaccgatctgatcttctcgcaggcccccgcacagcgccgggcggtgatcgacgaattccgcggcaccaattattcggtcgtcgacctcgatctgatccagtcgatctatgaagacctctatcagcagaaggtgaccggggaagaccggttgcgcatccgtgccggccagcgtatcaccggcgtctcggccggggagggcggaatcgcggtggtcacccgcgacacgatgtcgggtgtgccggccgccgagacctaccaggccgtcattctcgccaccggctatgaccgcgacctgccgcgcgatctggtcggcgcgctcgacccccatgtcacaggctgggagccggaccggctctaccgcgtgcccatggccgacccgtcgggcccggtcctgcacctgcagggcgcctgtgaagacagtcatgggttgagtgatactcttctttcagttgtggtgatccgggcgcaggagatcgcgaccgcgctggcggcgcatctggaccggatggatgccgccgccgctccggcccggcggccggccctggcgggggcggctggctgaccgatgatcccggcactgctcccgctcgaccccttcctcaccggcgactatgccgcccatcgcgacagtttcgccatggcgggcgtgggcgaggcaggcgccggggaggcgggggtgccgcttgccgatgccgccgcggtcggtgcggcgctcaccgccttcacggcgccgctcggccccgcccggcgggtggcggcggtctcccaatggaccaagtcgtatttcgccgtactgactgttccctcggttgcagcaaccctgctgctcgactgcgatctgccgctgtcgcccgagggcggcatcaccatggttctgggcgaaaacggccggcccgccggcttccgtctgcccggcgacgcccggccgctcggccccgaccggctggggaccgcctgcggcttcacccgcttttccgggctgatcgacgaccatctggccgccatcatcccggttttcgccacggcgggcggggtgccgcagcggatgatctggtccaatgccgccgattatctggaccgggcggcccgcatgctcgtgccgctcgcctcggcctggccggggcgcgaggcggcttctgccgggcttcagtccctgctcgccacgcccgaccgccccgacggcagccccaacctgctgcacgagcccgtccgcctgatgaacggcctgcgcacccgcaaggtctgctgcctgcgctatgccatgccgggcgaggatttctgcggcagctgccccaaacgccgccgcgccgaagccgcccgcgccgcgcgggggtagggcagggcaccaccccgattttccggacctccccctgaatgcttttctcccccctctgcctctcttcgcggcggcccctcgccgccgcgctctgcctcagccttctgcccgcaaccatccatgcccgcgaggtggtcattaccaccaccacccacggcattccccatatcctggcgcccgatctggaagcggcgggctatggcgccggctatgcctatgccgccgccggcaatgcctgcctgctggccgatgcgctggtcaccgtgcggggtgaccgctcccgggttttcggccccgatgccccggtcgagctgatcggggccgggtttccaacctcgtctcggacagcttcttccgcgcctatctggacgatgcccgcctcgccatcgccgatcccgaggccgatgccctgatccgcggctatgccgagggctacaaccgcttcctcgcagaggccggccccgatgcgctgccggcggcctgtcgcggcgccgcctgggtcaccccggcgacccccgccgatctccgccgcctgctcgcccgccttgccatccaggcgagcggcggccgcttcgccgaggccattgccaccgcggcaccccccaccgccactccaccaggtgacggaccggagcagcaggccgccaccgacccgctgaccccgccgccggcgctggccagcaacggctatgcgctgggcggcgatctcaccgccgatggcggcgggctgctgctcggcaatccgcatttcccctgggagggcggtctgcgcttcttcgcgctccacgtcaccgtcccgggcgtgatcgacgtgatgggggccacgctggcgccgctgccgctgccggccatcggcttcaatgcccggctggcctggacgcataccgtctcgaccagccagcgtttcgtgctccacgaactccgcctggtgccgggcgatcccaccgcctatctggtcgacggcgtggccgagcggatgaccgcgcgcgacatcaccatccccgtccgccaggcggacgggaccgaggccacggtcacccgccggctgtgggagagccggttcggcgccgtgctcgccatgccggcacgcggcctcgcctggacggccgagaccgcctgggcgatcaccgacccggagcgcgccgacaccagccttgcgacgcaatggctgggcctcggccgggccggcagcgtcgccgaggccgaagccgcgctgatcgccacccgcggcacgccctggatcaacacgctgatggccgatgccgacggccgggcgggccatgctgacctcaccagcgtgccgccggtgaccgatgccctggcccgggcctgcgcgccttcggccagggcagggacgatcgccgccgcggcccgcatcaccatcctggccggcgaccgtgccgcctgcgcggtgccggggctgatgccggccgatcagatgccggtgcgcaacagccgccggttgttcatgaacgcgaatgactcctattggttgtcggaccccgcgacaccgctcaccggcctgcccgcgattctgggcccgaccgacgtgccgcagcgcctgcgcacccggatgagcgcccgccagctcggcgaactcaccggccggcccgggcccgccatcgcgccctcggatcttgaggccatgctgttctcggaacgcaatctggcggccgatctggcgctcgatgccgtgctcaccagctgcgccggccagcccgacctggccgaggcctgcgccgtgctcgcccgctgggaccggctgagtgcgcccgcctcccgcggggccgggctgttccgtcagatctggcggcgtctgggggcggatccgggccgcgctggcggcttctggtcggtgcccttcgatccggcacaccctttcgataccccgcgcgcgccggatgcgcacgacaaggggacagcggatctgctgcgcggcgcgcttcgccaggccgtggccgatctccgggcggccggtctcgccctcgatgcgccgctcagtgcctttcagcagcggggcggcatcgcgctgcgtggcggcgacgatgccgagggcatgctcgacaatctggggctgggcccgctcggccccggcgggttcgacaccacggcaccctatggcaccagctgggtgcaactggtccgctggcgccgtctggccgacggcaccaccgcgccggtcgcccgcggcctgctgacctatggccagtcggccgacccgtcctcccccctccataccgaccagacccggctttatgcggcgggccggctgttcgatctgccgttcacggcagagcagatcgccgcagatccgggtctgacccgtcgggtgctggatctgcccgactgaccggccgtcaaaaaaaacgtcatctgccctgaaaaagtcacgcggccgaccgtcctatccgggaatgcgagtgccaaccagtcgcaacacaactgggcacccgcaacgggacacgggaagattgacgcaaaaaatgcagaagacgggagccggttggaccatgggcggtcggaacaggacagaggcacgcgcgcaggccgcgcgccggcgacgggccgagatcgtggcggatgtcgcccttgcggtcggcatggccggcatggtgctggctcaggcccccgccgcgcgcgcggccggggccgacggcgtgcagctggcgcaggccgggcagggctatgacatccccgcccagtcgctgaccggggcgatcaccagcttcggccgccagtcgggccttcaggtcacgctggatgccgccgtcgcgggcgatctgcgctcgccgggcgtgcgcggcagctacaccccggaagaggcgctgcgccgcctgctgcagggcacgggcgtcacctatcgctttgtcgatgcgcggacggtgaccctcacccaggtggcggggcagggcgccgcggttctcgatccgctggaagtggatgcggaccgccaggtcgaaagccccttccggccgatcgccggctatgtcgccacccgcaacgtcaccggcagcaagtccgacgtgccgctgatcgaaacgcctcagacgatttcgatcgtggtgcgcgaccagatcgacgcccaggccgcccagaccgtgccgcagtcgctgcgctacacctcgggcatgatgaccgaccgcaacggcctggacgagcgcgccgactttctctatgcccgcggcttcaaggtcgacagctatctgaacggcacccgctatctgggcggcacctgggccaccgcccagatcgacgcctatgcgctggagcggattgaggtgctgaaggggccgtcctcggtgctctacggccaggcatcgcccggcggcatcgccaacggcatcagcaagcagccgctcgaagacccggcgggggaagtccgtcttcagtatggtgaatacaaccggatgcaggcggccttcgacctgaccggcccgctcaccgaggacaaagacgttctgttccgcatcaccggcctcggccgcggtgccgacacccagatggagcagaccaaggaagagcgctactggatcaatccggcgatcaccttccgccccagtgaagacaccaccctcaccctgctcggcagctatcagaccgatccggcgcttggcggttatcagcgcctgccggcctatggcacggtgctttacaaccccgctggcgaaatcccgaccgatctcttcgtgggcgaccccactttcgacaagcaggagcgcaagcagtactcgctgagttcgctgttcgagcaccgcttcgacgacaccttcaccttccgccagaatgcccgcttcatgcggacggattccgatttcggctatctctacaccggcaacatcatgtcgccgaccagcagcctgatccggcgcagcggcgtgatcgccgacgagaccaatgacggcatcaccgtcgacaaccagatgcaggcgaagttcgcgaccggcgacgtcacccataccgcgctgctcggcctggactatcagaacaaccgcaacgacagcgttgtcgactacctgctggcgaatccgatcgattacgccaacccgagctatggcaatccggggatcgatttcgacaatcccttcttccagcagagttcgtcgcagcgcttcgagcagaccggtgtctatgtccaggaccagatgtcctatggcaactggcatctctcgctcggcggccgtcacgactggctggacatcgacaccaccgaccgtctcctgaacgctgaaagcaacctgaccgagaataagttcaccggtaaggtcggcctgctctaccacttcaccgatatcgggctggcgccctatgccagctattccgaggccttcgagccgatcgccggcaccaccaccgacggcaaggcattcgaaccgctgacctcgcagcagtacgaggtgggcgtgaagtatcagcccaagggctggaacacgctcttcaccctgtcgctctacgacatcacccagcagaacgtcgccaccagcacggcgcgcgagatcaatggcggcatcgtgaacttcaccgatcagagcggtgaggtgtcatcccagggtctcgacttcgagatccgcgccagtccgttcgacaacttcaacgtcatcgcgtcttacgcctacgtcgatgccgaggtcaccaaggccggcgacatcaccggcaccgagggcaagaccccggtttatgtgcccgagcattcggggtcgctctgggccgattaccgcttcatcgacggttacgtggcgggcctgggcctcggcgccggcatccgggtgaacggcaagacctgggccgacgccctcaacaccgtcgaggtgccgggctacgccgtctatgacgcggcggtcagctatgacctcagctacctgaacccggattttgccggggcgaagttccagatcaacgccaccaacctcaccgacaagatctacgtcgccgactgccagaacctcaccaactgctactacggcgcgcgccggaaggtctatgccacgctcagctaccagtggtaatcagcatccgcagaatgcggcaaccggcggtggtggggttgacctgccgccgccggcggtcgtctggaagggggcggtgatggagggtgcctttcaggcccgcgggctcggctttgcggtggccggccggccgctgctcgccgatgtcgatctgggggttgagaaggggcgggtgctggggctgatcggccataacggctcgggcaagagcacgctcatgaagctgctcgcccgccagatcgcgcccacgaccggagaggtcagcctcgacggccggccgctcgcggcctggggcgaccgcgccttcggccgcaaggtcgcctatctgccgcagaccccgccggccgccgccggcatgacggtgcgcgaactggtccggctgggccgctatccctggcacggcgcgctcggccgcttcagccgccgcgatgccgagcgggtcgatgcggcgatggaggccaccgacaccacccgctatgccgaccgcatggtcgacagcctgtcgggcggagagcgtcagcgggtctggatcgcgatgctggtcgcccaggacgccgatttcatgctgctggacgagccgatctccgccctcgacgtcgcccatcagatcgaggtgctggacctcgtccaccgcctcgcccgcggcggcgccgatgggatagggcaggggccgggtgtcgtcgtcatcctccacgacgtcaacatggccgcgcgcttctgcgacgacatcctggcgctcaaatccggccgcgtcctgctccgcggcggccccgccgacctgatgaccgaagacgccctcgcccgcatctacggcgtccgcatgggcatcctgccccaccccgccggcggctggccggtcggcttcgtgtactgagcgcgagggcaggggacagccatgaccattacccgccgccacctcatcgccggactggtttcggcaccgcttctacctgcggtagcccgcgccgccgcgtcgacgcatcagccggccgatctgccgcgccggatcgtggcgctcgactggtcctcggccgagacgctgatcatgctcggccggccgccggtgggcatcgtgcgcatccccgattatcgggcctgggtggtggagccgcccctgcccgacggcgtggctgatgtcggcatgcggctggagcccaatctggaggtcgtccaggcgctcgcccccgatctgatcctgatcgcgccgggccttgaagccgtgcgcgcgcggctggagagcatcgcccccacgctgcgcctgcaggtcttcacccccggccgcccggcctttccggccgccatcgccgaaacccgccgtctggggcagctgctggggctggaagatgccaccgaggctgccctggccgcggccgaggcgcgcatggaccgggctcgcgcgcagctcacccgctatgacggccggccgctctatgtcgtcaacgtgctcgacgaccgccatgtccgggtgctggggcagacggggctctggcaggccgccctggaccggctgggcctcgccaatgcctggaccggcgacagcggcccctggggcatggccaccgtcggcctggaacgcctgaccaccaaccccgaggcccggctggtgcatgtcgcccccggcccggccggtttcgaaacccgcctcagaaccagcccgctctggcgccatttcgacatgatccgggcgggcagggtggtgggtctgccggctgttttcccctttggcgcggtgccttgtaccgttcgcttcgcggaatgtctcagtcgggcgctggccgcggaggcaggcgcatgagcctcgccctcgacctgccccgccgccgtttccacccgggccttctggtgctgctgctcgccctgccggcgctggcgctggcgctgctgcggctcgacctcaccctgggctccggcgcctggtggccggcactcctcggccccgataccgagaccggcagcgccgtcgatatggcacaacttctggtccattattcgatgcttccgcgtgtggcggtgtcgctgcttgcaggcgcggcgctgggcctcgccggtgccgtgttccagcaggtgctgcgcaacccgatcgcctcgccgatgacgctgggcgtggccgccggtgcgcggctggcgctcaccctcgccacgctctgggcgccggcgctggttgcggttgacggagggggcgtctccggctgggggggccgcgaactggtcgcggtagccggcggcggcctcgccacgctcgcggtcttcgggctcgccgcccgccgcggcctgtcgccggtatcgctgatcctggccggcatgatcgtcagcctgtattgcggcgcgctgggggcggcgctcaccctgctgtatgaaccctatctgacggcgctgttcatctggggcggcggctcgctggttcagcaggactggcagacaaccctctggctgctgccgcgtcttgcggtctgcgcggtgctcatcgccgccatgatccgcccgctcaccctgttcgagctggatgacgagggggcggctgcgcttggcctgtcgctcggccgggtgcggttcctggccctgctgctggcggtcgcccttgccggcttcgtggttgccgccgtgggtgtcatcggtttcgtcggcctcgcctccccggcgctggcccggctggccggcgcccgccgcgtgcgcgaccggctgctgtgggcgccgctgatcggggcggcgctgctctgtctcaccgatcagctggtctggtttctgggcgagcagctgccgacgggggccgtcaccgccctgctgggtgcgccgctgctgctctggatgctgccgcggctcgcactcggcggccgccccgaaaccccgccgatggcggcagaacccggccgtgccccgggctttctgccggccgcgatcatcggcctcggcattctggtcctgctggtcgtggtggcactcgcactcggccgggcgccctcgggcaccgtcaccggccagactgtgtggctgtggagcgacccgttcaccgccgagatgctgcgctggcgctggccgcgggtgcttgccgccgtcaccgccggggcggccatggccgcggccggctgcctgatgcagcgcttcaccggcaatgccatggccagtcccgaagtgctcggcatttcgggtggggccgccattgccaccgtgctcgccggctttctgctgccggtggtcgaccggccggcgcagatcctggccagtgcggccggtgccgtgctcacgctgctgttcatcatccgcctcgcccgccgctcgggcttcggccccgaacgggtgctgctcgccggtgtcgccatgggggcgctgttcgatgcggtggtcgtcgccatgctggcgaccggcgatccccgtgccacccagctgctcgcctggatggtcggctccacctatgtcgtcggcccggccgatgccgtcgccaccgtcttcgtcgtcgcggccctgctcgcgctggcgccgctcgccgcgcgctggctcgacatcctgccgctcggcaccgccaccgcccgggcgctgggcgtaccgctcggggccgcccggctggtggtgctgctgatcgccgccgccctctcggccgccgccacgctggtgatcggcccgttgagtttcgtggggctgatcgccccgcatatcgcccgtctcgccggttttcgccgggttctgccccagcttgccgccgccgtgatcatcggcgccgccattctggtcggggccgactggctgggccggaccctgttgttcccgcgccagatgccggccggcctgctcgccgccctggtcggcggtccgtatttcatgtggctgctgtggcgccgcgcctgaccggcgccacagcccctcagaccgcgggccaaaccccgaaaggacctgtcccggatgtttgccgaactgctgcggatcctgaagccgttctggccgctcgcgctggtttccaccctgatgggcacggccagcggcttcgccaccaccgcgctgctcgccaccatcaatgatgcgctgcataccgatggcggcgccaccaccgcgctcctgctgatcttcgccggcctcgccgtgctcaccctcgtgggcgagacggtgtcggatatcggcaacagcctggtcggccagcgggtggttgcccggctgcgccatgatctctgtgcccgcatcctgaccgcaccggtggcggaactcgaacgctatcgcctgcatcgcctgaccgccgtgctcaaccaggacgtcgacaccatcacccagttcaccttcaacttctcgggctttgcgatctcgatcgccatcgcgctcggctgcttcgcctatctggcggtgctctcgcccttgatgttcctgatcgcgctggtggcgatcatcctcggcaccgccggccacacctatgcccgccgcaacggctttctgggtttcgccgcggcgcgtgaggccgaagacgagttgcaaaagcagtaccgcgccatcaccgagggcgccaaggagctgcgcatcaaccgccgccgccgggcggagatgtacaatgtgcagctcgaccgcaccatctcgtcgatccgcgatctgcgcatgcgggcggtccggatcttctgcaccgccaatgccttcggctcggcgctgttcttcgtggtcatcgggctgatgctggccattcagtcgatgtcgccctcggccgatcagaaggtgatcagcggtttcgtcctggtcctgctttacgtcaagggcccgatcgagggcatcgtcgccatgctgccgctgctgggccgcgcccaggtctcactgcgtcgcatcgccgatctgcgcgcccgcttttcggaagcggagccgcatctgccgctcaccgaccgcgccaccgctctggagccgctggagcggctggacctttccggcgcccgcttcgccttcccggagcccgagggcggcaccgcctttgaactcggccccatcgatctcaccatccgccgcggcgaaatcgtgttcatcaccggggaaaatggcggcggcaagaccacgctgatcaagctgttgctgggcctttacgaaccggtggcgggggaggtgcgttataacggccggccgctgacgcccgagctgcgcgacgattaccgccagatgttctcgaccatcttcaccgactactacctcttcgacgatctgaacctgcccgacggcgtgctgcccgatgaggcgcggcgttatctcgaagagctggaaatcgcccacaaggtctcggtgaaggacggccgtttcaccaccaccgatctttccaccggccagcgtaagcgcctggccctggtccatgcctggctggagggccggccggtgctggtcttcgacgaatgggcggccgatcaggaccccgaattccgccgcatcttctataccgagctgctgccggcgctgaaggcccagggccgcacgatcatcgccatctctcatgacgaccgctatttccacatcgccgaccgccatatccgcatgcagggcgggcgggtgatcgcggccgacgggccggaccaggatgcaccgcaggcagagccgcgcccggcccgggccggctgatatccagccttaaaaaaagaagcagggcagggggtttcgcgaacaccctgccctgatgtctgaacccggaagaccggtgccgtcactgccccggcaggatgaccggctgatgtgtgcccggcggctgggcgtcctgaatgccgttatcggtattccaggcccgaccgccgcccgccacctgctccagcgcctcgtcgctcaactcgtcctcggccggcagcacgatgtggatatgggcgggcgtgtcttccactaccgaaatcgtcagcccggccgggatctccattccgaacagcgccgtcaatgcggcatgcgggtctgtcttcagccgtgcgcggaacccggcatcctcctgagcccgggcgataatctgccgcagggcgtcgtcacgatcgatcacgcgtggtctccttgtcggtaaagcgcgcggggttgtcaggcggatcggtgtcaatcgccgtgcccgaagccgcgcgagatgatgcccgagcccgtcgtctggttagaaccgccattccatggcccgccgccgccggccacctgctccagtgcctcgtcgctcaacgtgtggtcggcgggcagcacgatatgcagatgggtgggcgtgtcttcccgcaccgacacggtcatcgtcgacgggatctcgactcccagcaacgccttcaatgccgcgcgcggctcggccttcaactggccccggaaaccggcgtcttcctgcgcgcgggtgatgatctgccgcagggcctcgtcatgatcgatcatggggacgctctttcgattggtgttgccgcaggctggcgattaatgctgccgcaggacggctcaggcctcgtcccagcccatcggccgtccgcccgaggcggaggtcggcccggtgttgaagaagtcgcgggcgatgccccagttcaccccggcaccgccggcgacggcctccagatctgcgtctgaaagttgatcaccagccgctggcaacacgatgtgcagatgtgtggggctgtcttcgaccacagtcaccgccacagccgaagggatctctatacccagaaacgatgcaaccgttgcgcgtggatcggcgatgagccgggcacgaaatgccgcgtcctccatggcttttgccacgatcttccggtgggcctcgtcatggccgatcatgcgtcacgcctcgcctggctcctttgtctcctgcaactcatgcgtcacgcctcgcctggctcctttgtctcctgcaactcatgcgtcacgcctcgcctggctcctttgtctcctgcaacactctggcaaggcgcaacgcggctgtcgaacggggagcgaggcgaatattaaccgcgattgatgcaacccccagccatcagtccgccctgtcagccggcgtcgccatttcggccccgctcattccagccgctgatccgggcggccatggcctccagcgcctcgtcggtcatatcgttttcgggcagcacgatatgcagctgctgcggcttgtcctgcaggatttcgatctccagatcgggcggcagatccaccccgaacatggcttccagcgtggcatggggggcgattttcaggctgtggcgaaacacgggatcgcgggcggcgcggtcggaaatccggcgcacggcctcctggcggctgatcatgcgatggtcgtcctgtcgatgtcgtctcaaaagccggatggtcgtcaatctcgtccggagaccgggctgatccagacggtaaggggcaagaccgccacgataccgacgtttcggccgcggattgttgcaatatgctgcaacctcgtcgagatcgacataggcgccagatcaacgatcattcatggaatgggcaggttcagccgcgcgcccccatctggcccgagttgtcgccggttcgacatccccccgcctctggcggtgccatgaaagtcgataatagatgattatcggactttagaagcgaatcatataggccgctaaaccgaagcatatcagcagaccggccggaacctaaccacatcaacttttacacatggcatccttgccaacacgcgtcgggcttccggccgcgcggacatcatcccacacaacagccatagggatttgccgccatgaccatccgaaccggccaatgcctctgtggtcaggtcacatttgccatcgaaggcgagccgatgcgcgtcggcatctgtcattgtacggactgtcggaaggaaagcggctcagccttcacctattatggtgtctggcatccggcccggactaatattacgggtgaaagcgtagaatatcgcggacagtgcttctgtccgcagtgcggtgcccggctgttttcgaaaaacggcaccgaggtggaaataaaactcggcatcctgtcgcccgcgccgaccggcctggttcccggctatgaactctgggtcaagcgtcgagagccctggctccggccggtcgacggggccgagcagttcgacgagaatcgccccgtcgcagacgcgggcgggtgagggcgcccgatcagccgccctcgcccgccgtccgtcttgattcttaccgccgccggcgaccgccgatgaagcgccgggcggctgcgacgatgccctcggcatcgatgccgtaatgggcataaagatcctcgaccgtgccggtctggccgaaatggtcgacgcccagcgccgccacacggtggccgttgacaccgcccagccaggcgagcgtcgccgggtggccgtcgatcacggtgacgaggccggcatgatccggcacctggtcgagcaggcgttcgacatgcgacaccgccgcgggctcgccctcggcgcgggccttttccgccgcggtccagccggcatgcagccggtcggccgaggtgacggccagcaccgcgacattgcggcggctgccgccgatcatgcctgccgccgcgatcgcctcggtgacggtgacgccctgatagacgatcaccacctcgcagccgggctccggcgccttcagccagtagccgccggccaggatatcggccgcgagggtatcgtcgatctcgcgccgcatctgctccaccggccgggtcgacaggcgcagatagaccgagccgccggcatcgtcgggcaggaaggtgtcggggtcgggggtctttttgccggcgcgctgcatatgcgcgaagccccagtccatgatcaccgccagctcgtcggcgaaacccggctcgaacgaggcgagcccgtcctggctcatgccgatcagcggctgggcgatcgactgatgcgccccgccctcgcccgccagcgacacgcccgagggtgtggccaccaccatgaaccgggcgtcctgatagcaggcatagttcagcgcatcgagcccgcgcgagatgaacggatcatagagcgtgccgaccggcagcagccgctcgccgaagagttcatgggcaaggccggcggcgcccagcatcaggaagaggttcatctcggcgatgccgagttcgatatgctggccctggggcgagaaatgccatttctgggtgctgggaatgcgctggcgctggaagatgtcggcgatctcgtcggcggcgaacagcgcgcggcggttcacccagccgcccagattggtcgacaccgtgacgtcgggcgaggtggtgacgatgcgccgggccagatcgctgtcggttttggcgatcgcatccatgatccggccgaaagccgcctgggtggaggtggtgccggcggaggcgaattgcggcccgatcggggccgcgaccggcgccgtcagccggcggctttcggtggtgttgaacggcacgcggtccaggaagtcgcgcagcaccgccgggtcgaggtccagcccttcgaagggttcccattcatggccggcgcggatgcccatggcgtcgcgcagcgcatggatctgcgcctcggtcatctggccggaatgattgtccttgtggccggcgagcggcgtgccccagcccttgaccgtataggcgatgaagaccgtcggccggtcgtcccggatgccgtgaaaggcatcgagcaggctttccagacagtggccgcccagattggccatcagatcggccagctcggcatcgctgcgccgggccagcagcgcgctcacctcgccctggtcgcccagatcgtcttccagccgctcccgccaggcggcgccgccgcggaacatcagcgcggaatagagcccgttcgggcaggcatcgatccaggcgcgcagcttttcgccgcccggctcggcaaaggcggcgcgctgcagggcgccgtatttcaccgtcaccacccgccagtcgaaggccttgaagatcgcctcgatccgctcgtacagcccctcgcggaccacgccgtcgaggctctggcggttgtagtcgatcacccaccaggtgttgcgcagcccgtgtttccagccttccagcaggcattcatagacattgccctcgtccagctcggcatcgccgacgagcgcgatcatccggccttcgggccggtcggtgcgcgcccaggatttggcgcggacataatcctgcaccatggaggcgaaggcggtgaaggcgacgcccagcccgaccgagccggtcgagatgtcgacatcgtcggtatccttggtgcgcgagggataggactgcgcaccgccgaagccgcggaaggccttcagcttgtccaggctctggcggccgaacagatactggatggcgtggaagaccggggaggcatggggcttgacggcaacccggtcttcgggcctgagcacgtcgaaatagagcgccgtcatgatcgcggtcatcgacgccgaggacgactgatggccgcccaccttgacacccgaggcattgggccggatgtggttggcgtggtggatcatccagttcgacagccacagcgccttgcggttcagcgcctccagcacggtcatatgctgccctgccatcttctcttccgtctcgcgcgtcaccatgccggtcatgggcgtttcactcctcccgtcgcaccgatggcctctgccaccgaacgccctattctgcgccgggttgagcagtggttcttgcctattttcggccccaaagacagactgcacgcagtgttctgctaaaaaggggcccccgcatggcagcatctgctgaacccgatctggacgccgtcgaccggcggatcctgagggcactgcaggaagacggccgcatcaccgtccaggcgctggccgagaaggtgggcctttccccctccccctgcctgcgccggatccggatgatggaagaggccggcgtgatcaccggctatgccgccctggtcaaccagaacgcggtcggcctgccggtctcggtgttcgtctcgatcaaactggaacgccagcgcgcccccgaactcgacgccttcgcccgcgccatcaccgcctggcccgaagtgatggaatgctacctgatgaccggcgcccgcgacttcctgctgcgggtggtctgtgccgacctcgcggcctatgaggcgtttctcagggaccggctgacccagctggacggggtgggctcgatcgaatcgagttttgcgttggggcaggtgaagtattcgcgggttttgccggtggggtgaggggtaggtgttgtggcgctgagcgcgatcagggggaaggccggctctggaaagtttggtgcggaatcgcaatcccgcaccaagccaatgccggaaccgggacgagctattacctatgtctccggtctgaagcactacccttctttccggtcgctcagtccccggtgacctgctgaaaatggacgaacaatgagtgccgaataattatcgtaccactttcaaaaggaataaggtatgccctgcgttccccgatagaatatagcatccagagaagcatttcctgtgctaaaggatccactcgatgtttctctaaaagtgaaacgccgatacatattaccatttctggaattccgataggatgtaaaatttttcaatagcatgcaatcggacgggtttggcaaaatccgaaaatattcactttcatgaaaacaaaatataagcaaacttggcgaatttctacaaaatcctatttgattttcataaacatcaaaaatataagaaccagagatattttttcttgcgctgagagcgactattctgcgccctccgttaatttcgcgaaattttcgccgatcaatcttctcataatgaccatcaaaattctttatgattgatctcaggacgtcggcaataaaatgatcatcgatactttgttctccatggtcgcacgacatgccaaccaacggccgtttggcgattggaacatctttccacatttttgatgaaacgaaagacgggtcgagccacccatccggatacccgggaggcctctcgggtggcggcctatcatccggatgccagccatagagttcaaaagagcggtacttcaaacaggcgataacctctgaatcatggtccgtgaggcttgcaagagccaccggaagaagaaccaggttggcgatacatgtgtgatagcgagggtcgtaacaggatttcggccagatatggcaggcgctatagcgcttgggcatcacaccggatccgaacacggctttcttaatggcttgattggccttcgaattatcatcaagagtaatgccgtttacgacctcccctcgtttctcatcatttctggcacggcgcgtattcggaaaccaggcaccgctcggattaagcttcctgcgctcctggaatactctcggatgggcccaaaggctgcaacctgccaccagcgccggcaacttcacacccaaacggactgttcccgctgcaagcaaatcatcaccgttgagcatgcagacctcttaggattagcggcgaattcacacaccgatcgaaatgtcattcaattttgggcggattttcgtgtgatcgcctgtcggcaaataagagactacgcataccggggcagcagatccatccatttttatccgctagagcgcattattgttcaaacaaactactataagtatatataatgttaatagtgtaaccggcacgtgcagcgacctctttacctccttgcccgcgatgcatgaccggccccatcatgctcgagcttactgataaggcaatctgccgtcactatgtctgcgcagcggagcaaaagcgtgcacccacagcgcagcggtttatggtctgatcaaaaagtcctgcggagcatccgtatatcgtcttcgaccctgatcatgtgaggggccttcgggccccttgttctgtggtttggggatcccggcctggaagggcgtgcgtcccttcatgccaggcccctcgtgcggctggttcatgcctgaaagaagccgataattcgaccgtagaggctttgaagatcggataggcgccgctccagtttcgagaccccggcaagacatatccccctcacccaaacctccccgtaatataatcctgcgtccgccgctcccgcggtgttgaaaacaccgcttccgtatccccgaattcgaccagttcgcccagatacatgaagccgaccttgtcgctgacgcgggcggcctgttgcatgttgtgggtgacgatcaccacgcaatagcgtttgcgcagctcccagagcagttcgtcgatgagcgcggtggagatggggtcgagggccgaggccggttcgtcgaggaggaggacgtcggggcggatggcgatggcgcgggcgatgcacaggcgctgctgctggccgcccgagaggctgaggcccgaggcgtggagcttgtctttcacctcgatccagagggcggcgtcgcggagggcggattcgacggcgtcgtccatctcggcgcggccgaggcgagtgtacatgcgcaaggggaaggcgatgttttcatagatcgacatcggaaacggcgtcggtttctggaacaccatgcccacccgggcgcgcagcccggcgatgtcgccgtgatgggcgaggccgcggcgggtgaggatgttttcgccgtcgagcaggatttcgccgtcgatccggtggccgggataaagatcgcagatccggttcagcgtgcgcagcagggtggatttgccgcagcccgaggggccgatcagcgcggtgatcagccggtcgccgaaggtgatgtcgacatccttcagcgcatgattgtcgccgtaatggaagttgagcttgcgggtgacgattttcgggacgagcccggcggcgtcgacgggggtggatgcggtcatttgcggcctcgggcagagatcaggcgggcggtgatggagagcagcagcacgccggctgcaatgagcagcgcgcccgcccaggcgagatcctgccagtcgcgataggggctcatcgcgaactggaagatcaccaccggcaggctgggggtgggaccggtgaggtcgtaggcatagaactggttgttgagcgcggtgaacagcagcggcgcggtctcgcccgcaatgcgggcgatggcgagcagaacgccggtcaggatgccgctggccgccgcgcgccaggtgacgccggcgatcatccgccagcgcggcatgccgagggcaacggccgcctcgcgcagctggtcggggaccagcgccagcatgtcttcggtggtgcgcacgatcaccggcaccgcgatcagcgccagcgccgccgcccccgcccagcccgagaaatggccgagcggcaccacgatcaggacatagaccgtgagcccgacgatgatcgagggcgcgctcaacagcgtgtcggcgaacaggcgcaccaggccggcggcccggctgtcgcggccgtattcggccagccatgtacccgtcagcacacccaccggggttgcgaccgcaatcgccgccgcggtcatcgacaggctgcccagaatggcgttgagcagcccgcccctgctgcccggcggcggggtcgcgcgggtgaagacgtcgagcgagagggcgcccgcaccacggatcaccagctcccacaggatcaacgccagcaccagaagggcggccagcgccgcgccggtgcacagccccgtcatcaccagattgaccagccgacgtcggcgcagccgtgcgggcgaaaccgggatggtgccccctctcatcgccccctcctccctcatcgacccgccctccccgtccggttcagcagcgcgcgggcgccgagcagcaccacgaaggtgaccacgaacaggatcagccccagcgccgtcaacgccgagacatagacatcgcccgaggcctcggtgaattcattcgcgagcgtcgccgagatggtggtgccgggctgaagcagcgaggcatgaatgcgatgggcattgccgatcacgaaggtgacggccatcgtctcgcccagcgcgcggccaaggccgagcatcacgccgccgatcagcccgcgccgggcatgggggatcagcacgcggcgcgatacctcccaggtggtggcgccgacgccataggcggcctcgcgcagcaccggcggcacctccgccagcacctggcgggcgaccgaggtgatgaagggcagcaccatcacccccaggatcagcccggcggtgagcacgccgatgccgaaaggcggcccctggaacagcgcgcccacgaccggcagcggcccgagcgtgtcgatcagcgccggatagaccgtggaggccagcaccggcgccagcacgaacagcccccacatgccatagatgatgctgggaatggcggccagcagctccaccgccaccgccagcggcgcgcgcagccggtgggggcagagttcattcaggaagatggcgatgccgagcgccgccggcaccgccaggatcatggcgatcgccgccgtgatcagcgtgcccgcaaccggtgccaccgcgccatagacatcggtcaccgggttccaggcctgggtgaccagaaaccccacccccatctgatccgccaccggcaggctgccgatcaccagcaccaccagcatggcggcaagtgcggccaccaccatcagcgcggcgatgccggtcagccgccggaacggcccgtcccagccaagccccgccggcagggcgctgaggtgcagcggccgggccaccggatgggcagaaacgatgtccggctccggcgcaaggccggcctcttcgacgctcatgaaacctcgcagggccgccgccggcaggggatgcccccacaggcggcggccggacgacagacgcaatgcacagacaacgccgggatcagtagacgggtttgccgtccttgcccttgatgctgtcggcccaggtcttttcgaccatctgcaccaccgcctgcggcatcggcacatagtcgagcttttccgccgcggcaccgccattggcgtagctccaggcgaagaatttgagcgcggcggccgcgcgggccggctggtcggcctggctgtgcatcaggatgaagctggcaccggtgatcggccagctgtcccggcccggctgatcggtcagaaccaggtgatagccttcggcatgggcccagtcggcattggcagcggcgctctggaaggtcttgctttccggggcgaccacggcgccgtcatggttcttcatcttcagccaggccagcttgttctgaagcgcataggcgtattcgacatagccgatcgaacccggggtctggccggtgaagttggccacaccctcattgcccttgccgccgagcccggtcggccattcgaccgcggtgctggcgccgatgtctttcttccagtcggcactgaccgaggagagataggtggtgaacaggaaggtggtgcccgatccgtcggcgcgatggaccacggcgatcgcctgatcgggcagtttgacgcccgggttcagggcgaccagcgccggatcgttccatttggtgatcttgcccatatagatcgcggccagcgtcggcccgtcgatctccagcgcaccggcggcgatgcccgggatgttgaccaccggcaccacgccgcccatgaccatcggccactgcaccaggcccgcggccttcagatcggcggcttccagcggcatgtccgaggcgccgaaatcgacggtatgcgccttgatctgcttgatgccgccaccggagccgatggactggtagttcagcgaaacgccggtttcggccttataggcctcggcccatttcgcatagaccgggtacgggaaggtcgcaccggcaccggtgatctcgtcggcggcctgggcggtgccgatgctcaggccgagcatcaacagtcctccggcaacagccggaaggcgacgaaggacggacatatgccaacatctccaacgggatatggatcggaagggccgcggcgagggcactataggcccgcgtcttccacctctgcatcccgattccaagtcgaccggccataattcatcaaactgacacatatcgacttgatattgacgattgcccattttgggcaatcttcagacatactcattcttgtttggtcatggtgactgctgctcttgtaaagatgcggtggcggtcatgaaaaaacggtcgcttccgaaacggaaacggccgtcgggcggctgatgacccggatggtttcgcttggccgccatgccgttggactggcaagggccgcgacatttaagcggcgcggccggtcagcgcagaaatgccgcctcgtcgcgcgccacctgatccatgccctgcaggcggaagatttcgccgaccggggcgatgccgccctcgacgcccagcgtgtcgccatcggccatgatccgggcgaagctctgctgcatggcggcgaccgcggcccggatcgcatggttgccatagatcaccaggccgacccggccgcttgccgcggcgcgcgccatggtcatctgcggataggcggtggggacgatgacgatcgggatgccgccatcccaggcggcgatgaagccctcgatctcgtcgggggtggtcgacttcgaatggaccagcagcagatccgccccggcggcggcataggcgcggccgcgctccagcgccgcacccggcccggcgccggcgatcagcgcctcggtacgggcgatgatcaggaaatccgggtcgttccgggcgtggcgggcggcctcgatcttgccctgaaactcggcgatccggagcaggtcctgacgcccgccctcgaccagcgaggtgaccttgggaaagaccttgtcctcgatcaccaccgcggcggcacccgccgcctcgtagctgcgcacggcatgcaggacgttgagggcattgccgaaaccggtgtcgatatcggccaccaccggcaggcgggtgcgggccgccatcgcgcgtacgacctccagatgctcggccatcgagaccaggctgatatcgggcaggccgagcgccgccgagatttcaaaaccgctggcccaggcgccgtcgaagcccgcctcttccaccagccgcgccgaaagcgggttgtgggcggccatgatgcgggcgggcgtggtgtgggcgggcgtggtgtgggcgggcatggcattgtgggcgccggaaacgcggtcgcggaaggcccgtcgggtcgatgtcatcgatcttcttccttgaaaagaaaaggattgcggcggatcagcacagccgcgcgatcgcggccgccatcacccgcacagcacggatcagcgtgtcgtcggccgcggcatagctgatgcgcagatggccgggtgccaggaaaccgctgccgggcaccagcgccacgccagcctcgtccagcagatacagggccagatcggtgtcggtggcgatcgcctgcccggccggcgtcgtccggccgatcagggcggtgcagtcgacgaacagataaaaggcgccctgcggcaggtggaaagacagacccgggatcgcggcgatctcgcggcagagcagatcccggcggcggcggaaggcgctgcggaacccctcgaccaccgccggatcgccgttcagcgcggcgatggcggcatattgcgcgatcgaacaggtgtgcgaagtcgactggccctggatggtgttcatcgcgcggatcagctcaaccgggccggcgccatagccgacccgccagccggtcatggcatgggatttcgagacgccgttgacggtgagggtgcggtccgccagatccggggcgacggcggccatggtcgcgaaggcggtctcgccatagaccagatgctcgtagatgtcgtcggcgagcaccatgacctgcgggaaatcgcgcagcaccgccgccagcgccgccagatccgccacccccgccaccgccccggtcgggttggcgggcgaattgagcatcagccagcgggtgcgcggggtcaacgccgcgcgcagcgcctcgggccgcagccggtagccgtcggcggcggtggtcgcaaccggcaccggcacgccgccggccagtttgatcatttcagggtacgacacccagcagggggtggcgaagaccacctcgtcccccggatcgagcgtcgccatcagcgcattgaacagcacctgcttcgcgccgcaccccaccgtcacctggtcgggggtgaaatcaaggccgttctcgcgggcgaatttggccacgatcgcctcgcgcagcggcaggatgccggcgaccgcggtataggtggtccggccctcggcgatcgcacggaccgccgcctcgcacaccgccgcgggggtgggaaaatcgggctcgccctggctgagcgccacgacgtcgcggccgcgggcgcgcagatccgcggccatctgggtcatcgccttggtggcggacggcgccacctgtctcatgcgggcggaaagcgtgatcattgtgtcggaaacatcccggcgtggagcagagggggaatggatgggagtggtcgccgcggcggagaacgccgcggcggggcagcggtgtcgggtcagcgggcggccgccgtgacctcctgccagatcgccagaacctggtcacggtcgcgggcggccgcatcctggtcgaccgcgatcaccgtcagatccgccagccgcggcaggccggcgatggcggtgacgtcgacccggtcattggccggccggcgccaggtggctgcaaagatcgccgcctgggcggcatcggaggccatgatgtcgagcagacgctgcgccgcctgcggatgcggcgcgcccttcaccaccgccatgccctcgggcgacaggaaggtgccctcggccgggtagaccaggcggatctcgctctggccgccggcgacataggcctcggcggaatattccatggtgatgccggccgcgaactcaccggccgccacgcttttgtagacattggacgagctgcccgtgaccacgacattgcgggcgagcttctccagcccctcgcggccgaagagctgatacaggccgtagatctgggcataggccgacgaggaattggcggggtcgccgatcaccacctggcccttccaggccggatcgaacagatcggcccagccggcgggcatcgaccggccgtcgagccggcggtcattgaccatcagcaccatcacgtggacattggcgccggtccagagcccgtcggggccgaccatgtcggcgggcagctcgaccctggtgtgatagggcgccagcacggcaccataggcggcgagcgtggggaaaccggcactccagaacagatcggcctcaggcgcggcggcctcggcttcgatgcgcttcagcagggcgccggtggcgccgcgcaccacctccacctccagatcgggggcggcgtcgcccaccaccttcagcagggcatcgaccgccgccgaattgttggaggcatagagcaccgcggtctcggccgcggccgggaggctggtgacggccaggctgccgatcagggcggtgccggccaggataagcgtcttgagcagggtggggcgtgacatgtcgggcttccgtcgatggggtggcggatggggcatgccgcagcgcgcacggaccgtcagtccgtggcgaagacacggatcccgaagatgcgggtcgcgagccagagcggcaggaagatggagagaagcaggatcaggctgtaggccgaggccgggcccatatagccgctgtcgatctgctgatagatctggatcggcatggtggtgagcccgggcgagtagagcacgatggtcgcgctcaactcggaaagcgtggtgacccagatgaagaccgccccgccggccatggccggccggagcagcggcagcacgaccttcaggaagctccgccccggcggcacgcccaggctgatggaggcttcctcgatcgaatcgcggatctgatagaccgccgaggcggtggtgttgacggcatagggcatgcgccggatgaaacaggcgatcgccatgatgacccagccgccggtgagcgcgacccagccgccattccaggtattgatcagcgcgatgcccagcaccgtgcccgagacggcgagcggcagcaggcccagatagtcgagcagatgggtgaggcccgagcgcttcttgatcgacagccaggccagcaccgtgccgaacagcacgcccgcgatcgaggcgagggtcgcgagaccgaaggaattgcgcatcgcctcggcgccgaaagaggccaggctggcgaaattgccgagcgagaaccgcccccaatgcagcaccgggccgatgctgtgggtgaaggcgccgatcgccaccaccgccaccggcagcagcgacagcagcaccatggcggcaagcccgccgccgaccagccgggcaagcggcgccggcaggtcgatccgcacgggcgcgcgccccgcctccatctgataaccgcgcccccgggccagccccttctgcaggatcagggccagcgccaccagggccaccagcaccaccgacatggtcgcctgcatggtgccgccgccgccgaattcgctgacgaaggcgttgtaggcggccaccgacagcaccggcacccgcggggccacgatcaccggcacgccgaaattgtcgaccgcaagcgtgaacacgatcagcgccgcggtggcgacgggcggcagcagcagccgcgcggtcaccgtgcgccagacccggccggggcccgagcccagcaccgtcgccgcctcttccagagaccggtcgacgccgcgaaaggccgccagcaccagcagatagacatagccgtaatgctgcaggaccatcacgaagaccagcccggtccagccgtagaaccccggcagagcgatgccgaagcggtcgttcagcagattggtcaccagcccgttattgccgaagaccatcagccaggactgggtgacgatgatgtcgggcagaacgaaggtggcgagcggcgccagggccagcagcccgcggcagggcagacgcagccgggcgacggcgaaggcgagcggcaggcccagcagcagggcacccagcgcggtcgcaagcccgagcgccacggtattgaccagcgcatcgaccagggccggggtggcgaagaagcgccggtaaccctccaggctccagccctcgggcccctgcaggctgagggcgaaaagccggaacagcggcacggcgacgaaggccgccagcaccgccagacaggcgagtttggcgacggtccagaccggaagcccgcgcatcgatcagacctcccgcaccagacagcagccgggcgagatttccaccgtcaccgcgctgcccggctcgggcgccgtggcgccgaacccgttgggctggatcagccgcagcgcggcaccgccttgaagccgaagctccacccgcgtggcctcgcccaggaaagtcagccgggtgaccgtcgcggccaggcggttgtcgccaccctgatcgcccgcgccgggggccaggatgcgggcctcttcctcgcgaatgcacagccgcacggcatcgcccgggcggcagccattggcatgggcggcaaggcgcgcgccactcagccggcactgcgcgacctcgccccggatcccgtccggatcgaccgccagaagattggcggcccccaggaaatcggcggcataggtcgatcgcggccgatgatagatctcccgcgggctggcgatctgctccaccccgcccgcgcgcagcagcgccacccgatccgacatggtcagcgccatacgctgatcatgggtcacgaagacggtggtgacgccataatcgcgctggatgtcgcgcacgaagctctgcatgccggcggcaagccgggcatccagcgccgaaagcggctcgtcgagcagcagaaccaggggctcgatcaccagcgcccgcgccagcgccacccgctggcgctgaccgccgctcaacgccgccggcaggcgatcggcgaaaccggccagttccacccgctccagacaggcgccgacccggcggcggatgtcgctttccggcacatggcgggccctgagcccgtaggcgacgttttcgaacacgctgcggtcggggaacagggcgtaatcctgaaacaccatgccgcaatcgcgccgatgggccggcagccgggtgacgtcgcgcccggcaaaggccacccggccgcgggccggcgccagaaagccggcgatcaggcgcagaaaggtggtcttgccgcagccgctggggcccaggatggtaaagaagcatccatccggaattgtcatgctttggccatcgatgaccggtcgcccgccataggtgacgacgacgtcgtcgatatcgattctggccatgtctcagctttcgtctgcgggtgtgccctgccctccccaatagcggcgacggatgaagatctcgtgacattcatcaggaaatgagattggtctatgaagcgtcgcatggatgcggcagcatgcggatgacgcaggggggaaggacccatggggatcgaccacgacgacatcccgctgaacgccctgcgcgccttctgcgaggtggcgcgggatgttcatgtgtcgcgggcggctggccggctcggggtatcgcaaagcgcggtcagccggcatctggccctgctcgaagcccatatgggcgcagcgctgctggaacggcagggccgcaatgtggtgctgaccgaactgggccgccagctggccgaagcggtgacagcaccactggaagagatcgccttttcggtgcggctgatgcggcgccggcgcagcggccggcgcactctggtggtgcgcacctctctgcccaccttcgccttcaccacgttgatcccgcggatcgccgatttcagccgcgaacacggcgacgtgccgatcgacgtgctgacctcggtcacctctcaggaactgcatggcgatttcgacgtgctgatcacccgcgatctggtcctgcccggccctgtgcaggaatggaccatcgccgaggaaaaggtggtctgcgtcgcggcccccgagatcgcccggcggatcaccctggcgaccctggcggcggtgccgctgttcatcgtcaattcccgccccgacatcctgcccgcctggctggcggcccgggggctgggcgagggcgatatccgcatgggatcgcgctacgaccatcactacatggccctgccggccgccatggccggccaggggctggtgctggcgcccgagacggtggtggcggattatctgcagaagggcctgctggcggcggtgcccgagacccgcttttcgaccggcatggtctacaaggcctatgcgtcggatcgcggcatggacccgcagctgagcgccgccttctgccgctgggtcgtccggctctgccgcggctgacgtcgcgctccggggtggtcttcgcaggcagtgaccggaccgcatggctgatatgagccgcagatcataggcagggccgcacgtggccggcagactgggcaggccgatgaccgccggcagtcacgaccgacggcagaccgcaggaggaaaccgccatgaccaacccgtccgccccacaccagacgctgcgcgacaaggcgtatttcgaccgccgcgccaccgacgagatggcccgacatctggcccctgccggccgcagcctgcacgagaccatggccacttcctgccggattctggcgatgaccggccaggaggccgggctggccgggcagatcagtgtgcgatccgaccgacccggcgcctattggacgctgcgcttcggcctgggcttcgacgaggcgacgcccgccgatttcatcgaggtcgaccgcgacctgaacacgctttcgggcgagggcatggccaaccccgccacccgctttcatctctgggtctatgatgcccgtccggatgtgaatgcgatcatccacacccactcgccctgggccgcagcccttgccgcggcccgccagccgctggtgatcgcgcagatggacatgaccccgctgcacgacgactgcgccttcctggccgactggccgggcgtgccgatcgccgatcaggaaggcgtgatcatttcggaagcgctggggacgaaacgggcgatcatcctggcccatcacggctatctgaccgcaggcggcagctgcgaggaagcgacctatctggcggtctatctggaacgggccgcccggatgcagctgcgcgcccaggcggccttcggtccgctgacgccggtcgacccgacgcttggcgccgaggcgcacgactatctgctgaaacccgtcatcgtcaacgcgaccttcgattattgggcccggcaggccggctagacctcggggggttgggcaaaactcggggggtgggcaaaacccgggggccaggccgtcacctgccgcagacggacgccccctacccgcccgctacgagagcggttccaggaaggtcgcaagccccttgcccgtcgaccagttctccttcgagacctcgaccagattgatgaacacgtcctcgggccgcagcccgggattgtcggccagaagggtgaccatgcggcgatagagcgcccgcttctggtccgtcgtgcgggtgttgttcaccgtcagctggataaaaaccagatcatcgctgcgctcgatgccgaagcaatgggcgccatagcggaaattcgccgccgtatgctcgtggatggtcatgaactggtcgtcctcgggcacgtcgaagctgtcgcgcaaagcctgatagacgccgtcgaaaatggcctggcgccaggcatcgggcttgccggcacgcagcgagatgtgaaccagcggcatgatggcctcctgatcatgtggggtgatggccctgaggctagccgcaccccaatcatttcgatatcctatgaattctgatatcagaaatcaggatctgaaatggcaggagcgcatggttgaccgccccctcgacctcgatgccgtccaggccttcgtgcgcatcgccgactacggcagcttcacccgtgccgccgaagcggggcgcacgacccaatcggcgatcagcctgaagctgaaacggctggaggagcggcttggctgccgactggttgaacgcacgccaaggcatgtcgagctctcggcccgcggcctggcctttctggagcaggcccgggccctgctggcggctcacgaccgggcctgtgcggtggtggcgccgcgccgccggcatctttccatcggcatcagcgaccatgtcgccgggccggaactgccgctgctgatcgcacggatgacggccggggatccgcagctgtcgatcggtatccgcatcggatcttcgggcgacctgctgcgcgccttcgaccggcgcgagatcgacacggcgatcgtgcgcttccaggagggccgggacgatggcgaaaccattgccgaagaacagttcggctggttcgccgccggaagctggcggcatcgcgcgggggaacccctgccgctggcgaccatgcccgagccctgtggcgtgcgggtactggcgggcgcgctgctcgatcaggcgggcatcgcctggacggaggtcttcaccggcgggggcgttactgcggttgcagccgcggtcgcagcgggggtcggcatcgcggcgctgtcgccgcgcatggtgccgctgggcacggtggatgtcggcccgcaactgggcctgccccggctgccacggttgccggtggtgctgtacagccgcgaccgcgacggcccggccggccgcgcggtggcggcacttgcggcggcatatcgaaccgcgatccgcggctgacggccccttgcgaccgggacgtggtccccgtcaggcgccgctgacgatcagcacatagggggtcagcgtggagacccgcccgccatgcggcagcagggccgtgcgcagcgccgcttccgggttccgcaggtcgtagacgccggtgacccgccgggtcatcagcgcctcgtcgcgcacgacgatcatgcccggatagcggcggcggatctctgccaccacatggcccaggctctggttttccaccaccagcagcccgtcgcgccagagagcgatctgggcgggctgaacccgatcctgattgaaccggccggtggcgcggtcgatatgcaaccgtccgcccgggtccaggcgggcatcgcggggggacccttcgggcaccgcgcctgcataggcgacatggaccgcgccgctttcgacgccgatatccagcgcctcgggatcgatgcccaccgcaaaagcggtgccgatatcgaccacccgcagatcatcgccggtcaccgcgaagggccggctgcggtcttcggcgacggtgaagaaggcgtcgcccccgatcagttccacccggcgctcggacgggccataggcgacgcggatggcgctgtcggccgcgaggattaccagggtgccgtcttcgagcgtgatccggcgctgttcaccgcgggcggtgacgtaatcggcccgaagatgcagctctatggtcggcagcaaggcgacgacgaccgaggccgcgagcgccacggcggcggtgaccgcgaccatccgccccagactgcggcgacggcgcagcggcaccacgcgggcaggcgtatccgccgcggcagcggccgggcggccgggcagcgcgccggtcagcttccagacccgctcggcccggcgccaggcctgttcatgggcagggtgcgcggcccgccagacgatggcagccgagcgcagccgctcgtcatgcgggcacgccctggtcttcaacagccagtcgacggccgtctccaggatcggatcgaccggtgcgtcttgatcttcctcggcgtggcccgtcatggtcctgcggcgtccggagcgttcagcctgctggggcgaccgggtgatctcccctccctccgttcagacgggccggccgcgtgttttttcagccatatactgcgcggacgcaagttcaatcgcacgcatcgaggcgttgtgcacaatggaccagcgccttcctgaccatctgatgcaccagggtgaccgagacgcccagatgatctgcgacctcctgcagggactggccggccatgcggtgcatttcaaaggcgatgcgggtgcgttcgggcagctcgtccaacgcctcggccacaacgcgcagctcgtcgcggtcgatcgcttcctgctcgggcgtgggggtggcggccggcagggcctggagcgcgtcgtcgtcgacatcagtgatgcgggcgagcgcgcggtggcggtcccagtccatggcgatattgcgcacgatgcggtaaagataggcgacgggatgcaggatcggattgcgtccccggccctcggcctctcccgcgcccacgaagcgcagccaggcttcctgaacggcatcttccgcccaggcgcggttgccgagcaggggggcggcataatccaccagggccgcacgatgggccaggtagacctcgagcttccgatcggcagtggtggtcggcggggttaccatgcggccgctcgctcatcgtcggttccggacgccggccgcgctgtttcgtcgcagcctatgcaattgcaacttactcgcatcttttgcagagggcaacggcagaagcgatcaacctgcggcggaccgggtggaccgtcggttacggccagatcaggttgaggctgcgatcggccacgcgcagcaccgccggcgctgacggcaacgggtcgccatcggcctggatggcgaggccggcgggcccctcgatcaccagttcgcgggccggcaggatgcgcacatccgaaagccggtccagccggcccgccgccagcgccgccccctggcgcaacagggccgccaccccccgcccgcccagcagcaccacatgcatgccgggccgggtgatgtcgccctccggcaccgcgcggaaggcgccgccatagagccggccgttcaccgccaccacgccatgggcgcgatggggcacgccgtcgatgcgcaccgaaatctcgggccagtcatagtggcggatccggtccagcaccggcggcagataggcgagcttgccccagcgccatttgagcgccggccgcgccgccagtgtcgccaccaccgccccgtcgaagccggcgccgaccatcagcagggcgtgccctgtcggcgtttcgatcggcgtcaccggccgcagccggccggtgaggaagggggcggccagcgcccggggcgcgcgcttcagccccatttccagcgccatgacattggccgtacccaccgccagcacgccgagcggcagcggaaaatcccgctgcatcagtccattggcggcggcattgatcgtgccgtcgccaccggccgcaaccaccgcatcggcatcttcaggcccggtgccgccggccagcgcggcgatctcttcgggcgtgcgggcctcggcgatcagcagccggcagccttcggcgcgcagcacatccagcgtccgctgcaacagccgccgccctgccccggtgccggccagcggattggcgatcaccagcagccgcggcgcatgcggcagggcaccgccgccctggctctggtccagaacggcgaggtcatgggtggatctcatcctgcggcacatctccgggcgcacgacgccgcccccaccgggccggccgccgccgagtgtcgcagagcgccggggaagttgccagtgacggtggtgcgacaacgccgcctcggccgcggcaggcaggggggccgccggtcgtggtcttacccccacggcgcggctggctctttgccgtttccggcctctccccggtcctgccggtgcgtgatgccccccagccgctccgtatcgggaccttccctgtcaaagcccgataatgttgccacatgcggcagcgccttgaacggcagggcgccccagaatggcaggggcccgtcaggccggccgccggcgcacggccggatgggtcgcccaggcggctggaacgtcgatttccatgtccagcagcatctggccgaagcccttgcccagcgggtcgttgcgcatcgatgccatgccgccgccgcccagcgcgcgggtcagcaggaagttcacggcatgcacgccgggcacgtcgaagcgggtgaccccgccctccggagccatcagatgcgcaaaccaggcctggaccttctcgggcgtgacctgccggcgcagccagggcaggaaatccgggtcacgggcgatgatgccgatattcgaactgtcgcccttgtcgcccgatcgggcccaggcgatcgaatagagcggcatccgcgtcgtcggttcgggcgtttcgccgggcgtggccgcagccggctcggcagccactgcgccggctgtatcctgcgacggcatgtcgggtacagggatccggacatgcatgacctcgtcgccgagcgtgacggtgaccgccacatcgcgtttcggcataaggaacgagaacagccgcaccaccggcgaggccttgggccggcccccggcgccggtggtgccgggcgaccacgaagtgccggcaggggcgatctcgcgggcgaagatgcccaacgccttgcggtcgtcatggcttgccgacaaccgcatgaccacctcgcgtgcaccacctgcccgggcatgcggtccatacatcgattcggcgcccaggatctcggtgcaggtcgcccggtagtcggccagattggcctggcggaacatcgcccgggtccgggccaggatcgcatcggcggtgcgctgcgccttggcggcggcatcgatgccgatgatggtcagctgcgccaccgcgcgccagccatccatataggtggccgaggccttgtagctgtcggtcggcgcgcgaccgcgtgtgccctgcacgcgcacgcgatcaggcccctccgccgccatcgtcaccgcggtgaagtcgcagatcacatccggcagcatataggccgccgggtcgcccacttcgtagagcatctgttcggccaccaccgccggcaccaccagcccgccggtaccctggggcttggtcaccacgaagctgccatcggccgcgcattcggcgatcggatagccgatatccgcccagtcgggcaccagatcccaatcggtatgcaggccgccggtggcctggcagccgcattccaggatatgcccgaccagactgcccgccgccagacgatcgtagtcgtcggccgcccagtcgaattcatgcatcagcgcgcccagcgccagcgcgctgtcggccgagcggccggtgatcaccacatcggcgccggcatccagcgccgccttcaccggcagggcgcccagataggcattggcgctcatcagtttttcgggcagggcggccccggtgaacatctcggtcacgccggaagcgcgcaactcgtccagcttgcccagcaggtcatcgccttccacgatcgcgatcttcagactgaccccggcctcgtcggcaagcctggtcaatgcggcagcgcaggcccgcggattgaccccgccggcattgctcaacaccttgattttcctggccgcgacatccttgatcaccgcccgcatcgccacctcgacgaagtcggtggcataaccctggtccggcgatttcgcccgcatcgaggccagaatcgacatggtcagctcggccagatagtcgaaaaccagatagtcgatatcggcccggcggaccagctgcggcgcacccacggcgctgtcgccccagaagcccgaggctccgccgatccgcacgatcctgtcgctcatggcgcgtcttctccaatgtcggggggagggattattgtcgcggccgggccgcattttctatatacctatcattaggtattgatgctcgcaagcggcaggatggtccccgcctgccctgcccccccgaaaagaaggccagcccatgcagctctctccctcgccccgcgccgccgatctcaaggcccggctcgaagccttcatggccgaacacatctacccggccgaggcccgctactatcgcgaaagtgaggaattgggcccctggaaggtccaaccggttgtggaggagctgaagcccctggcccgggtggcggggctctggaacctgttcctgcccgaaagcgaccatggcgccgggctctccaacctcgattacgcgccgctctgcgaggtgatgggccgctcgcatctggcgcccgaggtcttcaactgctcggcccccgacaccggcaacatggaggtactggcacgctatggcacaccggagcagcaggcgcgctggctgacgccgctgcttgaagggcgcatccgctcgggctttgccatgaccgaacccgccgtcgcctcgtcggatgccaccaatatcgaaagccgcatcacccgcgatggcgatgactacgtcatcaacggccgcaaatggtttaccaccggcgccacggatccgcgctgcaagatcctgattttcatgggtaaaaccgatccggacaatgccgaccggcaccgtcagcaatccatgatcctggtgcccatggatacccccggcatcaccgtgcaccggccgctgccggtcttcggcttctacggcatgcccgaccgggcgtcggaggtgagttttgaagacgtgcgcgtgccggcggcgaatatgctgctgggggaaggccgcggtttcgagatcgcccagggccgcctggggccgggccggatccatcactgcatgcgcctgatcggcctggccgagcgggtgctggaaaaggtctgcgcgcgcgccgaagagcgggtcgccttcggccgcccggtcgccgagcagaccgtcacgctggagcggatcgccgaggcaaggatcgccatcgaacaggcccgcctgctgaccctcaaggcggcctggatgatggacaccgtcggcaacaaacaggccaaagccgagatcgcgatgatcaaggtcgcggtgccgaacatggcctgccgggtgatcgacatggcgatccagctgttcggcggcgccggcgtcaccaatgatttcgccctcggcgccgcctatgccaccgcccgcctgctgcgcatcgccgacgggcccgacgaagtgcatcgcaaccagatcggccggctggaactgcgccgtcagcgggccgcgcggagctgatccgcggttcgccctcgcctttcctgtttgcactgcggcagtttcccgtcatattcgccggatattgatggggtctgccggaggaaccttgccgcatggatcgattgttgttcgggtggcggatcgcctctgacattccgttgcctgaacttcccctgtggccggctgccagccggcccggcgaggtgcagccatacgaggagcggccggccgacatcaccatccgccgcggacccgtgcccgcccgctttgccgagatccgcgtggaacgcccgctgttcaccctctctgcggacggcgagatgcggatcgacgtcaagggccatcatgtcttcctggtccgcgacggccgcgaggtcgtgatcgataccggcacgcccgatgatgccgactgccacacctatcttctgggcccggtgctcggcgcgctctgccatcagcgcggcgaggtgatcctgcatgccgccgtactgcgtttcggcgatgcggcggtggcgttctgcggccagtcgggcgccggcaaatccaccctcgccgccagcctgctggcccgaggccatcgcatgctggcggatgacgtcaccgtcttgcggcgggggcccggcagcgacgcacgcaccctggcctggcccgcctatccacgcatgcggctctggcaggatgccgccagccgcagcgccatcgacaccagcgcgctcgaccgctgcgtcttcgacatcgagaagttcgtcgtgcccgtcgatcccgccttcgacaccacccccctgccgctcgccgcccttgtccatctggatcgctgcgagagccctgcggacgaggcgttgatcccgctcaaggggctgaaggcggcggggcagctgcgcgacaatctctaccgcgccggcatggcctatgcactggaccgcgccacccccctcctccagaacaccgcccgcctggcggcgggcatcccccgccatctgatcgcccgccgccatatcgacgacggcgcggcagagcggctggcggatcggatcgaggcggcgatcgccgccggcagtgaggcgtaacgagcccgatctaccgaccagaatacccgccaaagcccggccgccccttgagggacggccgggctttttccggtcagctcatattgggcagatacatgatgatcccggggaagagcaccatcaccagcaccagaatcaggtcggcgaccaggaaccacatgatgccgcggaagatctggctggtcgtcaccaggtttccgaccacacccttgatcacgaagacattcatgccgatcggcggggtgatcatgccgatttccaggaacttggtcagcagcacgccgaaccagatcaggctgaagccggcggcatcgatgatcggcagcacgatcggcatggtcagcagcatcatgcccagcggttccaggaacatgcccagaatcaggtacatgaccgtcaccgccagcagcagcatataggggttggcgccgatatcgatcacgacggtcgagatccagtcaccggcccccgacagcgccagaaaacggctgagcaggctggcgccgatgccgatgatcaacagcgcgctggtggtgaccagcgtctcctgtgccgcagtccggaacatcttccaggtgaaggtgcccttggcgatggccaccacgcaggacaggaaagcccccaccgcgcccgcttccgttggggtaaacagcccgccgaacaggccgccgaacacgcccagcatgatcgccagcaccggccaggtatcgcggagcgcatccagtttttcggaaagcggaacgtcttcacgcacctgcggcgccagcgccgggttcagcttcacccggatcaggatcaccagaatatagcccagcgccgtcaacagcccggcgaccagcccgcccaggaacagcttggtcaccgccacctgggcgatcacgccataaaggatcatcaggatcgacggcgggatcagcgcgccgatcgtgcccgccgccgccaccgtgccggtggcgagctgggcgtcatagcggtggcgcatcatttccggcaccgcaatccgccccatcgctgccgaacaggcgatcgacgagccggtaaccgccgcgaagccggcggagccgaacaccgccgcgatggcgagcccgcccggaatgcccgacatccacaccctggccgcccggaacaacccctgggtcagctgggcgtgatagcagacgaagcccatcagcaggaagacgggcacggaactcagcacccagttggccgcgaactgataggggatcaggccgagcgaactccacgcgaccttccagccgagcagataccagatgccgccgaaggacacgctgaccagcgccatgccgatcggcacccgcatggccagcagaaggaagagcaggccgatgccggccagaccgataccgacgtcgctcatccgtgatccttcccgccgacgaccacatcatccggcgtgtcgtccctgagccccgaggccgcgcccgtcacatgggtcgccagccggtagagcacaaccagtgccatcagcgccgtgccgaccggcaggatgtagtaggagggccagatcgggatccgccagccttcctggatcacgaaggcgccgaccgcctgtttcttcatcgcctccagccaggactggcgggtcatggcgatgaacaccgccgccgacagcacataggcgaagccgcgcagcaccgcctgggcgcgcgccggcaaaaggtcggtcaccacctccaccgagatatgcttgtcgccctcttccgcataggcgagcggcaggaaagcgaccaccagcatgtagaaattcgacacggcggcgattgtgccgggcagggcgatcccgaacagattgcgcaccaccacgtcagccgtgatgtgcagcatcatcagggtcaccgccagcacgccgatcaccgacgtgaaatggatcagacgcgacaatccgcgtccaagcgcctgcatcacgcgctctcccatgggtcggaggggcctgcggaaagatgaacaaagggcggcgacacctgccgccgcccctcaggctcacatgccgtaggttttcacatcgaccttggagaccacttccgtccagtagacttcggccagctcgtccggcgtcttcacctctttcacgatcttcgcccatttctcaagcagcggcttgaaggtgtcgatcgccgcctgcggctcggccacgccgaacttggaagcatagaattcggcgatggtcttcatgtcgctctgcacgaagctctgggtctggtcgatcagcgcctgatcggcatgatggatccggatgcccttggcctcggcgcgcttcagatcgcggccttcgaagttcacatactgccagccggcatgggccgacatataggtaccggcgcggagcagcgccgcgcgctggtcttcgttcagcccctgccaggtgtcgacattgatgttggcgatcgccgaggcgccgaacacgccgcccggcacttccggcgtgatgtcgctgaccgcatcgatcagcgccaggccggaaagctcgggggctgaaatgatcgcgcagtccaccgccccctgggtcagggcctcgaagatctcgttaccgggcatggaaacggcggtcgcccccacgctttccgaccagcggcgccagttctggctgctgacccgcagacgcttgcccttgatttcctcggcgttggtcaccttcttgttgcacaacagcatatagcgggtagaggcggccgaggcggtgaagacctggttctgggccttcatatcgttctggcaggttgggcagtgcaggaagacgtattccagcatggcgctctggaagatcagcccgtcgcgaccgccggtatccatcaggttcagcagcatggtcaggtcgccggccaggttcatattggcgaattcggccgggttgtaggcggtcagcacatagccgatgtcggtgatgccgtcgcgcacgccgccgggcgtttccgccaggttcagcagcgacagcgggaacaccttcaccgacagcgtccccttgctcagctcctgcaccttcttcacatacacatcggccgcaatggtcgatgcggtgttggccggaaagccgatggcatagcgcagctcttcggcctttgcggcctggcccgcaaaaatgccggctgcagcaacaccggccgccacggcataggaggccagtctgcgggcaagcggggtcctggtgggcgtcatgatgcaatcctcccgtcgggtcatttcttttgttttcgtcatgtcttttattttacagaggcttgtcgcccctttttgcgccgtcaggcgcagctcacgccggctcgaaatgccccgcatagcggctgcggagttcggtcttccgcaccttgccggtggcggtcatcggcatttcttccaggaacaccaccagcttgggcacctcgaagccgcccagctgcctgcggcaatgctccacgatgctctcttcagtgggttcggtgccgggcttggccaccaggaaggcggtcaccgcctcgccccagcgggcatggggaatgcccaccaccaccgcgttctgcacgtccggatggcccagcagcacctcttcgatcttgatcgagggcacgttctcgccgccggacttgatcatgtccttcttgcggtccaggaacagcagctcgccatgctcgtcgatcacgccgatatcgccggtatggtgccagccatgcagccgcgccgccgccgtcgcctcgggctgcttgtaatagccgagcatggcgttggggccgcgatgcacgatctcacccggcttgcccgggggcagcagattgccgtcgtcatccatgatcgcggtgtcgttgacgatgcaggattcgccccagtaattgccgaagcgcaggcgggcgcgttcaggccgcgacatcacggtaccgggatacatctcggtctggccgctggagaggcggaaatcggggcagaattcgtccagcagccgccgcatcagcggctcgggcatcggcgccatggcatagacgcacatgcgcagatgaaggctccgttccttgcgcagcgggtgctccagcagcgcccggtacatcagcggcaggccgaccatgatggtcagcccctcggcggccagcccctccagcatcaccgccgggtcgaagccgcgcatcagatgcatcttggcgccgcccatcatggtggtcagcagcacggtgtgttgggcgcagtggaacagcggcagcacgcccgtcacgccatcctcgcggccgatctgccattcgatcgaattgctcatcgccgccatcaccaccgccagatggcagtgcatcacgcccttggggcgcgaggtggtgccgctggtgtacatgatcagggcaagatcgcgctcgtcgatcgccacctcgggctcgaccgtagaccggccctcaatcgcggcaccgaagctgatatagggcagcgaccccttcggcaccgggctgcccggcacctcgatcaccgtcaccggccggcccagtttcgccagcatttccgccatggcgggctgggcggccagcacgtcgtcggccaccacatggcccacctcggcatggcgcatgatgtagtcgatgtcgtccacgcccagcatcgcattggccggcacccagaccagcccggccttgtggatgccgaaaatcaccgggatgaaatcggtggagttggcgcagatgcagccgaccttgtcacccggcttcagcccctgggccagcagatagttggcgaagcggttggcatcgtcgtccagcatgcgataggtggcgcggcgatcgccttcgacgatggcgacccggtcgggatgccggcgggccgtacggcgcaacacgtcgccgatggcgacgcggccgatctgtcccggccccggcacgccctcgatcatgcgctccgagctggtggtcatggcagtcaatcctccctggcggcttccattctgtgcggggaagctctggtcgtgcggttggggcgcgtcgtcagctgccggcggcccaggcgggctggcgtttttcaaggaaggcggcaaccccttcctggccttcggcgccgcgcaggcagcgggcgaattcggccgaagagaggtcgagcaggtcgggcagggccgtggtccgctgggccatcagcaggcgcttggtggtggcgttggcgccgggagcgcagcggcggatatccgccaccagcttcgccaccctggcctccagcgcagcaccatcctccaccacctcgtgcaccaggccgatccggccggcctcggccccgtcgaagcgcatgccggtcagggccaggcggcgggcctgcgacacgccgatgcgtgccgccacgaagggcgcgatctgtgccggcggaatgcccagcccggtttccgacagggcgaagcgggcatcccgggtggcgatgaccacatcgccgatgcaggcgaggccgagaccaccaccaaaagctgcaccttcaacagccactacaactgtctggggcagggcctcgatccgggtcaggaaatggccgaagcggcggttgtcggcctggatcgggtcgggctggcccgcctcgggccgggccgcccggaacgacgccatgaagcccttgatgtcgccgccggcgcagaaggtgccgccggcaccgctgatcaccagcgtgccgacctcgggatggtcttcggcccaggcgaccacctcggtcagctggcggaccatctcgccggtcatggcattgcgtacgtcgggccggttcagcgtcaggcgcagcaccgggccgtcgcggtccagcagcagatcggggcagatcggaagcttggcagcgggcgtggatctggtcgtgggcatggccggggggccctcaatcggtcttgcggccgggcaggatgcccatgcccttggcgatgatcgacagcatcacctcgtcggcaccgccgccgatcgaggtcaggcggccgtcgcgataaagccgggtgacctcggtctcgttcatgaagcccatgccgccccagtactgcaggcagccatcggcgatttcgcgcgtgaagcggccggcgcagagcttggccatagaggccagatgggtcatgtcctggccgtcgacatagccttcgaccgcgcgatagatgatcgagcgcagcagctctaccttggtctgcaactcggccagcttgaaatgcaccacctggttgtccagaaccggtttgccgaagatcatccggttgcgggtgtattcaatcgtgtcggtgatcgtgctttccagcaggcgcagggaacaggccgagccccagatgcgctcttcctggaactgctgcatctggtagacgaagcccatgccctcgtcgccgatgcgatagcgctgcggcacgcgcacgccgtcgaaatggatctgggccgtgtccgacgcgcgcatgcccatcttgtcgagcttgcgggcgatggtgacgcccttggtcttcatcggcacgcagatcagcgacttgttgcgatggaccgggccctcgccggtattggccagcaggcagatccagtcggcctgggtaccgttggtgatccacatcttgccgccgtcgatgacatagtcgtcgccatccttgcgggcccgggtcttgatgctggcgacatccgatccggcgccgggttccgacacgccgatgcaggcgacgcggtcgccggtgatcgccggtgccaggaattcctggcgcagttcgtccgatccgtgcttggccagcgccggggtggccatgtcggtctgcacgccgatcgccatcaccaccgagggtgagcgcgcggcgctgatcgcctcgcagaaggccagctgataggtgtagtccaggcccagcccgccataggcctcgggtttgttgatgccaagaaagccctgatcgcccatcttcttgaacagctcatgggccgggaagatgccggcatcgtcccattcctggacatgcgggttgatctcggcttcaacgaacttcgtcaccgaacgcatcagttcgtgatgctgctccgtgtaaagcatctgcctctggctccttgcgggcgtcatggcgcggggggagaccgcgcggatgtgttgggaaggggagtgtgaggaagggatgtcgggaagggtcgcttgccttatatacccttatatctaacaataggcattgaacgccgggcttgtaaagtctccgcgcgacctcgcggccatgatacgggggctcgcgcaggtgcagccgcggtgttatgttgcaacgcagccagaacatcggggttttcatcgcatctgcgaaatgcccgggtgtccgccatcatcagatccaccgcagacaggcgttccgcggctggtcgacgacacggggttccgcatgcaaagacttggcgccatccgcccggccgatgatctggacgacaatgaccgcgtggcgctctatgtccgcctggcccggatcttccgcgaccgcatccgctcgggcgaatggtccccgggcgaaaagctgccgccggtgccggatctctgccgggatttcgccgtggcgccgatcaccgtgcgccaggccctgcgcatgctcgccgacaagggcctgctgatcgcgatccgcggcaagggcaccttcgtgaccgaaggccagcattccgcggtcgacgatccggaactccgccgggcgatcaacgaccggctggacctgacccccggccagggcatccgggtgctgaagcgcgagaccggcatcgcactgcccccggaactgcagatggaaggcggccatcccagatccagctatgtcaagatcaccaagatccatctctacaatgaaacgcccttcgccctgatggacgtttatgtcgacgaagcttcttaccgccacttcccgccgaattcggagcatggctccaagatgctccgcatgctgaccaaccacggccccgacaagatgggctcgtcgcgccagctgatcaccatctcccacgccgatcaggacgtcgcccgcgccctcgattactctctggcggggtgatggtgaagatcgtctccaacatcttcagcatcgacggcgatatcctgatggccaacaacgcgctctatcgcggcgacatgttcgtgatggaacgggtggaacagacccccgccgtcccggtcatccccgacccgacccggcccaaggaccggcattgatcggcacgcagaccatggaggatccatggacgccggccccgggctgaccgccatcccccagctcgacgacctgatcgacgccatcgacagcgcggccgaggccttcgtgctgtgggatgcagacgatcgtctggtgttctgcaacgaccactaccgccgcttcttcggcgagcccgacagggtgcggccgggggtgcggttcgacgagctggtcgagatgaacatcgtctataccagcatttccgaaatcagcttcctgccccagggctgggatcccgaccgctatcgcgagcgccgcatcgccgcgcaccgcaccgccagcgacacgttcatccagctgcgcgacggccgctggctgcaatcgcgagagcggcggacccgttcgggcggcatcatcggggtctattccgacatcaccgagcggatgcgcaccgaactcgcgctctctgccgccaaacaggcggcggaggatgccaatctggccaagtcacgctttctggccgccgcctctcatgatctgcgccagccgctgcatgccgtcggcatcctgatgtcggcgctttcggcccggctcaccaccgatcgccagcacgccatcgccggccagatcaacgactgccttcagaccgtgaccgggctgttcgatgccctgctcgacatctcccgcctggatgcgggggtggtggcgccgcagccggtcgacctgccgctcggccccctgctccgcgcgctcgcccgcgaattcgagcccgccgcccgggccaaggggctggagctgaccgttcggccaggggcggtggcagggatggcggccgcggtgcagagcgacgccgccatgctggggcggatcctgcgcaatttcgtctccaacgcggtcaaatacaccagccgcggccgggtggtggtcggcgtccgtccgcggggggcggatctcaggatcgacgtcatcgacactggccccggcttcgatgcggcagaggcccaggcggtgttccgcgaattccaccggctggacggcgccatggccgaacaggggatcgggctcggcctcgccatcgccgaccgcctggcccggctgctcggccaccggatcgaggtcataagccgaccgggccacggcacgcgcttttcgctgatcctgccgcgggcggcccatctgccggtaccggagccggtcgccccggcccccgccatgccggcgggtctggccggccggcgcctgctgctgatcgacgacgaccccgacatccgccgcgccgccgcccagcttttcgacgcctggggctgcattgccgcctttgccgccggcgcccatgatctggccggggttctggatgccatggacggcccgcccgaggcggtgatcatcgattacgttctgggtgacggctggacgggtgcccgcctcgccccctgcctgcgcgcccggttcggcgatgccctgccgatggtgatggtcaccggcgacacggcgccggagcgcctgcgcgaagtgcaggggctgggctttccggtgctgcacaagccgctgaaccccatgcggctgggggcgacgctcagggcgcttctcccatctcagaccggcacatctcagcccctgtagcgccgcgccagcgccgccgcctcggcacgcgagcccagatccagccgccgcagcatctgcgacacctggttcttgaccgtctgttccgccaggcccagccggtcggcgatcgcccggttgggcaggtcgtgggccagaagtttcaggatctcgccctggcggcgggtcaggcccagcgcgccggcatccagccccaccggggcgtcggcggccggctcctcggcatccagcgccgccgggggcacgtagatgccgccggccagcaccaggcggagcgcactttccagcacctcggccctcagcgatttgggcagatagcccgccgcacccgccgccagcgccttgcgcatgatcgccggctgttcgtcggccgaaaccaccgccaccgcgaccgaggggaagtggcggcgcagcacctccagcgcctccagccccttggcgccggggatgttgagatccagcagaaccagcccgatctccgggtcgcggcccagcgcatccgcggcctcggtcagggtcgcgacctcgaccacggcggtgccgggggcgcagagttccagcatttcgcgcagacccgaccggatcagcgcatggtcatcgacgatcatcgcccgtgcgacggacatggcctcaggcctccgatcatgaacggtacggtaccagtgtaccgggcgtcgatgacggttcggctgtcggccggatccgcagccagccgccgcccgcgggcgatggatgcaggctcatgcatgcaggcatgcggtacgtggcgttgccgtatggtcaagcctgcgacaacagaaccgacacattccgggtctaaggtcgcggccgtcatccaccggcaccagaggatgcggaccacatggcggcgatcgacatctgcggcatcaccaagagcttcgggcgcaccgaggttctgaaacgggtcgatctggacatacgggacggcgagttcctgaccctggtcgggccgtcgggctgcggcaaatccaccctgctgcgcatcatcgccgggctggaaagccagaccggcggcgagatccgcatcgccggcgcggccgtcgaccatctgcgggcccgcgatcgcgacctcgccatggtgtttcagtcctatgcgctctatccgcatctgacggtggcggaaaacatcgccgtgccgctcagcatgcgccggctgaatgccgcccggcgcctgccactgctggggccgctgctgccgggcacccggcggatcacggccgggatcagggccgaggtgatggcgaccgccgccatgctcggcatcggccatctgcttgcccgccggcccggccagctttcgggcgggcagcgccagcgggtggcgctgggccgggcgatggtccgccatccccgcgcctttctgatggatgaaccgctctccaatctggatgccaagatgcgggtgcatatgcgggcggaaatcgcccggctgcaccgccggctgggcaccaccttcatctacgtcacccatgatcaggccgaggcgatgaccatgtccgaccggctggcggtgatgatggagggccgcatcctgcagctcgacacccccgacgcggtctatgacgacccggccgatatccgggtggcggaattcatcggcagcccgcggatcaacctcgtcaccacccggctggcccccagcggccggctgctgctgggcgacaggctgctggcgctccgccccgccgtccccggcctcacccccggcaccgaaatccggctgggcttccggcccgaacatgccgacctcgtccccgccgaccgtgcggcgctctcaggccgggtttccctgctcgaaaacctgggctcggacctgctggtgcatctggagctggacgacgcggccggtggcggcacggcggtggtgcggctcgatcccgcccgcggccgcccggccgagggggagatctgcggcattgccatggggccgaagccgctcgccttcggcgccgatggcgcccggctgccgcttgcagccgccccggcggcggagatggcccatgtctgatcaggccctgcatcttgcccgcggcgccctggcgcctcgaagccgcgcggcggcacgggccgaacgtctgcgcgccatgaccgcctgggcgctctcggcccccgccgtgatcctgatggccctgctgctgatcggcccggtgatcggggtgatggcgctgtcgctcaccgactatcagctcggcgccagcacactctcgtatatcggcctcgacaactatgccgagatgttcggcgaccgggtctttcacaccgcgctgatcaacacgctgctctatgtcgcggtggtggtgccgggctcggtcttcctggggctcggcatcgcgctgctgatcgaatccggcacgagcggccgcgcgctctatcgcgcgatctatttcctgccggtgatggcgacgctgatcgccatggcgatcgtctgggaattcatgctccacccccaattcgggctgatcaacctggccctcggccggatcggcatcccggcgcagaactggctgaccgatggcgatctggcgctctgggtgctggccgccatcggcatctggcaggcggtcggcttcaacatggtgctgttcatggcggggctggtctcgatcccgcgcttcctctacgacgcggccgagatggacggcgtgccgggcgcctgggcgcgcttccgcctggtcacctggccgatgctggggccggtcaccctcttcgtggtggtcatcacctcgatccgctccttccaggtgttcgacacggtgcatgtgctgaccaagggcgggcccaacaaggcgaccgaggtgctgctctacaccatgtatgccgaagggttcgaattcttccgctcgggctatgccgccgcggtcaccgtggttttcctgggcttcgtgctggcactgacgctggtcaagatcggcgtcctggaccggaaggtgcactattcatgacccgccccgcctcccgtccccatctgcttcttcccgtactgcgccatctggttctgggccttggggcggtgatcatgctcgcccccttcgtctggatggtctccacctcgctcaagcccgcggccgagatctttctggaccatatccggctctggccgcaccagctggcggcggcagaaaactacaccaccgccgtcaccaaggtgccgctgctgcgcttcatgctgaacgggctgatcgtgaccgtcacgatcttcgtgatccaggtcgcggtcgccctgcccgccgcctatgcgctggccaagctgcgctttcgcggccgcgggctgatcttcggcgccatcctgttctgcctgctcatccccccgcatgcgatcgccgtgccggtcttcctgctcttccaccagctgggcatcctgaacagctatgcggccatggtggtgcccttcaccatctcggtcttcggcatcttcctgatgcgccagttcttcctgaccgtccccgacgatctgatcgatgccgcccgcatggacggctatggcgagttcgccatcgtctggcgggtgatgctgcccaccgccgtcccggcgatcaccgccttcggcatcttctcggtcgtcgcccactggaacgactatttctggccgctgatcgtggtcaatgatcagcacctgctgaccccgccgctcggcgtggtcgccttccgcaaccaggaggcgggcagcgatttcggcccgctgatggccgccgccacgctgatcatcgcgccgctggtgatcgccttcctcttcgcccagcgccggttcatcgagggcatcaccctgaccggcatgaagtagccacccttccccccctcacggccttccacctgtccagagaggacgcaccccatgttccggacgctgctcaccgcgtcggcaatcgccgtcgcgaccgctgccgcactgcccgccgccgccgcccagccggtggaactggtcatccagtacccctatggcgagctgttcaacgagacccacgcccagatccgcgaggccttcgcgaagatccatcccgagatcaccctcacctaccgcaccccttatgcggaatatgaggaaggcacccagaagatcctgcgcgaggcggtgaccaaccagctgcccgacgtcacctatcagggcctgaaccgggtgcggatcatggtcgatcgcggcattgcccggccgctcgacggctatatcgccgccgaaaaggacttcgaggccgaaggtttccatcaggccatgtacgacatcggcactcagaacggccatgtctacgccctgcccttcgccatctcactgccgatcacctactggaacctggatctggtgcgcaaggccggtggcgaccccgccaacctgccgaccagctgggacggcgtgatcgacatggcgaagaggatcgacgcgctcggccccgacgtgaacggcatcagctatgtctgggacatcaccggcaactggctgtggcaggccccggtcttcgcccatggcggcaccatgctgaccgcggacgaaaccaaggtcgccttcgacggcgcggaaggcaaattcgccatgcagaccatcgcccggatggtcaccgaggcgcatatgccgaacctggcccaggccgatgcccgcgcgaccttcgcggccggcaagacgggcatctacgtcacctcgacctcggacctgaccaaaaccaccaacatgatcgccggcaagttcgagctgaagacccatgtcttccccgacgtgacgcccggcatcggccgcctgcccgccggcggcaatgtggtgatgatcgtctccaaggacgacgcgaagctggacgcggcctggcagtacgtgaaattcgtcaccggccccgaaggtgccgcgatcatggcccgcaccaccggctacatgccccccaacaagaaggccaacgaggtctatctgaaggacttctacgtccagaaccccaaccactataccgccgtcagccagctgccgatcctgaccaaatggtacgccttcccgggtgagaacggcctcaagatcaccgatgtgatcaaggaccatctgaactcggtggtcaccggtgcccgcgcgggcgagcccgatgcggtgctggccgacatgacccgcgacgtgcagcgcctgctgccgaagaagtgatgccgatgaagctcatccatctcaccgacacccatttcgtccgcccgggggagaggctttacggcctcgaccccagggcccggctggatgcctgcatcgccgacatcaaccgcaaccatgccgacgcacgcctggcggtgatcaccggcgacctcacccattacggcgaccgcgcggctttcctggggctgcgcgacgcgctggcggcgctggccgtgccggtacggctgctgctcggcaatcacgacacggtggaaaccttccgcgaggtcttccccgagacgccggtggacgccgacggccgggttcagggcgtggaggataccgaggccggccggctgatcttcctcgacaccaacatggccggcacccatgccggctggtacgaccggccccgcctggactggctgtccgcccgcctcgccgaggcgcccgaagggccggtctatctgttcatgcaccacccgccctttgcgctcggtatcgcctccatggaccggatcggcctgatccgcccggatgatttcgaggcctgcatcgccccccaccgggcccggatccgccacatcttcttcggccatgtccaccgcccggtctcgggctcgtggcgcggcgtccccttctcgacgctgcgcgccaccaaccaccaggtctggatggatctgacgtccccggagatccgggtcagccacgaacccccggcctatgccgtggtgctgcttacccccgaccagacgacggtccatacccacgacttcctggacgccggcccggtcaccgacctcaccgacatcgccggcagcttctgggacgaacaggcccggcgggcggagatggcggaaggctgacggccgggaccaaaacacggcgtgccgtcagccatgacagcgcgccgtgtttcgacgcgatctgcattccgatcatgaggcggtcatctggaagggaacgcagttggcgccatccttcaccatgtcaattcgtccacgcccgagtggcgagacacggtcggaatcggaactacggaagcagccggccttccttccacgcacccataaagggcgcattttttcacctgtgccccggggttcgcgtgggggtgggcggattcaggcgtcatcgctctccggcaggtccatgtcaagcagccaggaactcaggctcttgccgtgctggtccaggcgaagcgagcgggtcaccccgccgccgagcgcgcggtggagaacgaagttgagggcgccgagcgtgggcaggcggtagcggtcgaccgggccatcaatgatgccggcgaaccggattgcgacgcggtcggcggtcagccaggcgtcgaggcgcgggaaatcggccgcgtcgtagacgatcaccgagatggtcgaggtgtcgcccttgtcgcccgtgcgggaatgggcgatgtcgtggagtttcatggccgcgctcctcaggcttcgaaatgacgcagcgtcgcgcggacccggctgcgcggcagataggtggagccgacgccgatgatctcgcggcaggacttcatcaccccgccgccgccagccgggccgttggtgtagagggtttcgacctcgtcgccgatccgcttcgccgcggccgccgtggccgtgcggccgatcacccggacgcggacctcggcagggtcggcccgtccctcggccgcggcggccccgtgcagcgcgtcgacgccgatcaggtcgaagcgcagctcttcggccaccaggccggtgaggcgcaaccggcccgcgacgatatcgagtgccagccgcccgcgggcaacggcgcccgggccggcataggagatctggccctcgccgaaatacccgtcggcatagccgaccgacaccttcaacgccgcggggcgcggccggccgttggcccccgctaccagtacccggtcggggccgtcctgggtgaaggtgatgtccgagaaatcggcgaccacgtcgggcgtgacatagcccgccggatcgaacacctcgtagagcagctgctcggtacaggtggcccggtcgatgcgtccgccggagcccgccaccttggtgatcacggcagtaccgtcttccgcgacctcggcgatcgggaagcccagacgctccagccccggcacgtcgcggcggccgggatcggcgaaatagccgccggtgatctggccggcgcattccagcagatgccccaccgccgtcgcccggccgagatgcgtccagtcgtcgagtgaccagccgaattcgtggacgagcggcgccacgaacagcgacgggtcggcgacccggccggtgatgaccacatcggcgccggcggccagggcctcgatcatcggcccggcccccagataggcattggccgaaatcacccgtgtacccagctcctgaagcgaggcgccggtttcttccagccgggtgccggtggggtcgagcagatgcaggacgtcgtcaccttccaccgcgaccactttcaggccgcagagccccagcgcacgggcaatccgcaccacctcttccgccgcggcgaccgggttggccgcccccatattggagaggatgcgcacgccattggcccgggccaccggcagaacggcccgcatccgtgcgtcgagcagcggatcatacccctttgccggatcgccccgacgggcctgctgggcaagcgcgatggtccgctcggccaggcattcgaacatcagatactgcacgtcgccatgcgcggcgatttcgacggcaggttctatgcggtcgccggcatatccggcaccggcgcccagtctcacccgcttcaaaggatggtcctccgtcacttctgtccggccagggctgtcccgccagggcggatcgggccgccgcaggccgggactgcggtcaacccgcggccgcttccgcgcgggcgaagccgccgccgggaatggcggcgagcaggtcgcgcgtgtaatccccgcggggacgaaggaacacctcgtccaccgccccgtattccaccagccggccccgctgcatcaccgcgatccggtcggagatcgcggccgcgatgcgcaggtcgtgggtgatgaagaccatggcgaaacccagccgcttctgcagatcgtcgatcagctccagcacctgggcctgcaccgagacgtcgagcgccgaaaccgcctcgtcggcgacgatcacctcgggctccatcgccagcgcccgggcgatgcagatgcgctggcgctgcccgcccgagaattcatgcgggtagcggtcgagcgcatcgggcttcagccccaccatctccaccaggccagccgccctgctcaacgcctcggccctgggcgtgccatgctgcagcggtccctcgatcagcgtgtcacggatccgccggcgcgggttcagcgagcggtagggatcctgaaagatcatctgcacgccgcggcgataggcctgaagctcgcgcccgcgaaagccggcgatgtcacggccgcgatagaggatgcggccgccggtcggcgtattgaacccggtcaggcagcggccgacggtcgacttgccggaaccactttcgcccaccacacccagcgtctcgccctcccccagggtcagggaaacgccatccaccgcccgaaccgcccggccgccgccgaacaggctgcggccgccatagaccagctccagcgcctcgatctcgatcaggggcgcggccgcggccagcggctccgccttcacctccccctggggcacggcatcgagcagcatgcgggtgtaggggtgctgcggcgccgccagcacctcggccgcggccccctgctccaccacctcgccctgacgcatgaccagcacccggtcggcgatgtcgtggacgacgccgaaatcatgggtaatgaacagcaccgcgctgtgatgcctgtcctgcagctcgcgcagcaggcgcaggatctgggcctgggtggtgatgtcgagcgcggtggtcggctcgtcggcgatgatcagtgccggttcaagcgccagcgccatggcgatcatcacccgctggcgctggccgcccgacatctggtgtggataggcgccgatcatccgctcggggtcgggcaggcgcacatcgcgcaccagctccagcacccgctcgcgcaccgccgacgccgcaaggcccggccggtggacgcggatcgcctcgccgatctgggcgccgaccgtcatcagcgggttgagcgcggtcatcggctcctggaagatcatcgccatccggtcgccgcgcagctcgcgcatccgggccggtgtggcggcgatcagatcctcgccctccagctcgatcgcgccgctttcgacacgcagcgtgcccggcggcagcagccccatcaccgccgaggcggtgaccgacttgcccgacccgctttcaccgacgatgcaaacgatttcctgcggcccgatatcgaggttgagcccacggaccgcatgggcccgatcgccccccttgggcagggcgacggcgaggttgcggatcgaaaggaccggagaggccgtaccggcagcctgtgcagtggtcatgggatcagctcctccggccggcgagcttggggtcgagctggtcgcgcagaccgtcgcccaggatgttgaccgacagcaccgtcaccgccaggaagccgccggcgaagaagatggtccagggcgcctgctgaaagtagttgcgcccctcggccagaatgttgccccaggtcggcacgtcgggcggatagccgacgcccaggaagcccagcaccgcctcgaccaggatcgcagacgcgaagatgtaggtcgcctgcacggtcagcggcgccacgcaattgggcagcacatggcgcagcagcaccagccagcgcggcacgccgaggcccagcgccgcctcgacataaggctcctcacgcacgctcagcaccacgctgcgcaccaggcggaccacccgcggaatgtcgggaaaggcgatcgcgatcaccaccgacacgaagctggcgccgaacagcgagaccatggcgaccgccagcaggatcgagggaatggccatgatgccgtccatgatccgcatcagcaccgcatcgagcagccgggtggcaccggcgagcaggcccagcacggtgccgatgccgaccgcgacaacgcacaccaccagccccaggaacagcgacacctggccgccatggagcacgcgggagaacaggtcgcggccaagcgcatcggtgccgaaccagtaggtcgcatccggcgccttcagccggaagcgcggcttcatgatcgtgggatcaaaactggtgagatagggggcgaggatcgcggccaggaccatcagggcgacgatcgcgagacccagaaggaccggccggctggcgagcacgcgccgtgcagtcggagacagggcaagggacatggcggccatccggtcagtagcggatccggggatcgatcaggatataggcgatgtcgatcagcaggttgaccgagacataggccagcgagaagaagatgatcaccccctgcaccaccggatagtcgcgggccaggatcgcatcgatggtcagccggccgacgcccggcaggttgaacacgctttcggtcaccaccacgccgctgatcagcatgccgataccgatgccgatcaccgtgacgatcgggatcgcggcattgcgcagggcatgcttccacaggatcacccgttcgggcacgcccttggcgcgggcggtgcggacgaaatcctcgctcaggatttcaagaatgctggcgcgggcgacccgggcgatcagcgacatgaagaacaccgacagcgtcagggtcggcagcaccagatggcgcaggctgccccagggatcatcgaaggggctgacatagccctgcaccggcagcaggtcgagccagagcgagaagcacaggatgaagatataggcgagcacgaagcccgggatcgaaaaacccagcaccgagaacagcatcagcagccggtcagcccaggaattgtgccgacgggcggcaatcacgcccatcggcaccgccagcgccacggtcacgatgatcgaggctgcggccagcaccagggtcggttccagccgcccggcgatctcgccgatcacactctgatgcgaggcgatcgagaccccgaaatcgccgcgcagcaggtccaggatccagatcccgtactggtgcagcagcggcttgtcgagtccgagctgcgccgtgatcgcggcgacgacctcggggctcgccaggtcgccggcgagcacggtggcagggtcgccggtcagcctcaccaggaggaagaccagcgtcaccaccaccagaaccaccggcaccgacatggcgaggcggagtgcgatcaggcgcagcatggatgccctccgctcagtgcttggcgatgccccagtacacctggacgggcgaatcgatcagcggatcgacgccggcgcggtgtgccgagacattggcataggtgccgagcgggatgtagaagaccagttcataggcccgcttctggatggcggcggcaaggcgcttcttctcggctggatccgatgcggccgcaaactcatccttgagcgtcgccagcgtcttgtcctcggaccagccgacatagccattgctcccgcgggtgtcgaggttcaggtttgagagcggcgaggtcaggtcgagcatgttccagttgccataggcgacgctccagccgccctgatccaccggatccttcttgttgcggcgctgcaggaaggtcgcccagtccatcgactgcatctcgacattcatgccgatctgccgcagggcctgcacggtcatgggcgcgacagccgacagcgaggcgaggtcggtcgggtgcagcaccaccaccttctcgcccttgtaaccggcatccttcagcagtgccttcgccccctcgaaatccggcgtgacggcggtctgcacggcaccctcttcggtggcgagcggggtgccgcagccgaacatggcgccgcagatggtatagagttcgggatcgccgatctgcgcatccatgaaatcggtctgcgagatcgcgtgcagcacggcctggcggaccttgacgttatcgaagggcggctgcagccagttcagccgcatggtcggcacattgctcgacttcagcttctggacctccacgccgtccacaccggtcaactgcccgaccgtgtcggcatagatgttctccagaatgtcgacctcgcccttggtcagggcattggccgcggtctgctggtcggggaagctcagatattcgacccggtcgaccttggcgaccttgccgccggccaggcccgaaggcgcctcgtcacgcgggacataggcctcgttccgcacatagaccgccttgacgccgggctggaattcgtcggcgacgaagcggaacgggccggagccgatatattcgcggatctgctcggtgggggaggtctcggcgatgcgcttcggcatgatgaagggcaccagcgaactcggcttggcgagcgcgtcgatgaccgcgccgaagggctcggacaggaccagacggaaggtcttgtcgtcgaccgtcacgaattccttcgccgccttcatcatccggataccggtgaggtcgcgcgcagcccagcggcggaccgacgcgacggcatcctctgcggtcaccggtgcaccgtcgtggaaggccaggccgtcgcgcagcgtgaaggtataggtcatgccgtcatcactgaccgaccagtccttcaccatctgcggctgcggttcgaaattcgcatccacggcaaacagcgtgtcgtagatgaaatagccgtgattccgcgtgatataggcggtggtggtgatcgggtccagcattttcagggccgcatggcccaccactttcagcgtggtcgtctcctgcgccgacacctgaagcggcgcgccgaaagcccccagcaggccaagccctgccagaactccggtcaatccggcgttgattttcatgctacggactccctgtgcattccatcgatgagccacccgggggatgtttttctagggcgatattttcgtcgcctcgtcattgccgtcttcggccggcctcctccaccggtccggggcaataaattcttgtaacatagcgtttcttgcggattaaatttggaaaatgacatcattcatacggatatcggtatgaatttgaatctgagacagttgcgcgccttcgcagccggcgcccgcgccggttccttctccgaagcggcacggacgatcaacctcacccagcccggctactcgctgatcatccgccagctggaggaggagatcggcatgaagctgttcgatcgcaccacccgccggctggcgctgacgcctgcggggcgggaattcgcgctccgcgtcgacaagatcctggccgatctcgacaatgcctgccgcgatcttgaggatctgcgtcttcggcgacgcggcaaggtgacgatcgccgtcctgccttccaccgcctccaccttcgtgcccaaggtcgtgcagatgctggcgcgcgaccatccgggcctctcggtctcgatcctggagcggctggccgcaccgctgatcgagagcgtgtcgaccggcgaggccgatttcggcttcggcatcagcctgggtgccgacgaggaactgcgcttcacccccatgattcaggaccgccttgtgggtctgtttccggccggggacgagctggcggagggtgccgcagcactgggctggcaacagctgatcacccggccctatgtctgcttcgtcgacaacaccagcctgcatcatcacgtagaccgcgcagcgcgggaaagcgggctggcgctgaacgtggtcagcgaagtgacctacatgaccacggccgtcagcctggtccaggcggggatcggcttcaccatcctgccggaactcgcgctcggcagtctcaatctcgacggcgtcatcatccgcccggtgatcgacccgccggcggtgcgcagcatcggcaccatcacccgggccggccgggtgaagagccccgccacccttgccgcgctggacgcgttggaccgcatctgtcgggaccggtcgagccgcctgatcctggccggtcattcataacgaattctggggaaatgatgttcaagtccaaatgacccggtcagaatccggcatgctatcgtgatgtccggccgcagacgcccaccgcagcctgctgctgcgcaagaagcaaagggcgccggcaaggaggcagagcgatggacaggaccagtcaaggcgcgcgcagctggaaacaggccgccggaacacagttctcatgcgagaaggcccccgccctcggataccggggcatggtcgtgaccaaccacccgctggcatcggcggcggcggtcgagatcctggccggcggcggcaatgcagtcgatgcgaccatcgccgcgctgttcactctgtcggtggtcgagccgatgatggtgggcatcttcggcggtgggaccgccctgatccgcctggccgatggccgcgaggcggtgatcgacggcctggcgacggcccccgccggcgccgcacccgacagttacaaggcggtgtccgacagctggccggactatatggaaaccgaagaccgcgccaatgccgtgggggcgagcgcggtggcggtgcccggcaatctcaaggcctggtgcgagacgctggagcgcttcggcacgctcgacctcgcgaccgtcaccgaagcggcgatccgccacgccgatcgcggctaccgcgccacgccctatctctgcaactgcatcgacggcacggcggcggatctgatccgcgatcccgaaatctcggcgatcttcacccccggcggcacaccgctgaagcccggcgacctggtccgccagggtgcctatgccgacacgctgcggctgatcgcgcgggaaggcgccgtggcgctccatggcggcgggctgggcgcgcatgtgggcgaagaactgacccgtgccggttcgttcctgcgcacccgtgatctgatcgactaccgcacggtcgatcgcgtgcccgtccggggcgattatcgcggctgggagatcgtcggcaccccgccgccctgttcgggcggggtgcatatcgtgcagatgctgaacctgctggaagggttcgatattgccggcaccggcttcggcacggcggaaggcgttcatcttctgctggaggtgctgaagatcgcggcctcggaccgccgcgcctccactgccgatccggcctatgtcgacgtgccggtcgaccggctgatctccaaggcctatgccgatctgcgccggccggaaatcctgcccgaccgcgccaatgtgttcccgccgcgggtcatttcgaccgagagcgccaacaccacccatgtcaccattgccgatggcgacggcaacatcgtcacctccacccagaccatcaacagcctgttcggcgcccggctgatcatccccggcaccggcatcatccccaacaactatatgtatctgttcgacccccatccgggccatgccctgtcgctggagccgggcaagcggatcaccagcacccaggcgccgctgatcctgtgccgcgacggccggccggtgcacgcgctcggcctgcccggcggccccaggctctacggctcggccatgcaggcggtggtcaatctgatcgaccacggcatgacgctgcaggaggcggtggaagcgccgcgggtctggacccaggggcaggatgccgagatcgaaaccgcggtgcctgaagccgtgcgcgaccgcctggccgccatgggccatgacgtccgcccggtcgggcatgtggctggcggcatgtgcgcgatcagcttcgaagccgacggcgcgatgaccggtgccgcctgctggcgggccgacggcacgccgatcggcatcggtggcggccttgcgcgtgagggcacgcagttctggcctgattaccgccgcaccgctggcatctgaatacccgccccgtcctccttcactgacatatccctggatggagatatccccttgtcccaggatctcatcgccctgtccgcggtcgaagcagtcggcctgctgcgccggggcgacatcacccccctcgacctgatcgacgccgccgaggcacgaaccgaaactgtcgacggggcgatcaacgccctgccgatccgctgtttcgatcaagcgcgggaagcggccgcattgctcgatcccgcgaccgcccggcgcaaggccggctggctggcggggctgccgatcgcggtcaaggatctgagcgatgtggagggcgtccgcaccaccatgggcggctcgccgatcttcaaggacaggatcgcgaccggctccagctatgaggtccgcaatcttctggcgaatggcgccctgccggtggccaaggcgacctcgcccgaattcggcttcaatgccaccacctacagccagctcttcggctatacccgaaacccctggaacacggcgctgtccacggccggctcttcgggcggatcggcggcggcactcgcgaccggcgaggtctggctcgccaccggctccgatctgggcgccagcatccgcgcgccggccgccttctgcggcgttgtcgggttgaggcccggccccggcctggtgccgcggggccccgccacctattcctcgaccctgctgccggtcaacggcccgatggcgcgcagcgtcgccgatgtggccctgatgctggacgccatggtcggccatcagccgggcgacccgctgtccttccccccggccgtgcccagctatcagaccggtctcgaccaggatccggcacagctgcgggtcggcgtgtccaccgatctcggcatcacccattgcgacagcgagattgccgggctgatccgcaatgccggccggattttcgagggcatgggcgccgcggtcgacgaaggctgcccggatttcaccggcgccatcgagatcttccacaccatccgcggtaccggccatatcgccggcatgggcaagctggtcgaaagccatcgtgatcagctgacgcccgagatcctgtggagcgtcgaaaccgcccgcaagcacgatgccgatgcgatcgccacagccgagcgcgagcgctcggccctctatgcccgggtcgccgccttcttcgaggcctatgacctgctgatctgcccctcgaccgtggtaccgcccttccccgtggactggaccacggttcgcgagcatgagggccatgtcttcgagcgctacatcgactggatcgcaatcaccttcgcgatcaccctgaccggttgcccggccatttcggtgccctgcggcttcaccgccgaaggcatgccggtcggtgtgcagatcgtcggccgcccgcgtggcgaacacgccctgctgaaggcggcagccgccttcgagcgcgctgcggcgcttggtcgcctgacgccgatcgatccgcgccagggatgatcatcacagtggaagcggaggccacggccacccgcttccacgtcttctcaatgcgccgccagcagcgcgccgaacccctcgacccggtcggtgatgccggcccgacgcagcgcatgccagtagagcgcggtgttgaccgcgatcaccggcttgtcgagccagaattcagccaccgccgccagccgcgccatgggcaggttggtgccaagctgcacgatcgcctccacggccggatcgttcaggcggatcagcgcgtcgcggatgatccggggtgacaggtcggccatttcgaccggccccgtcgcctgcacgccgcccacggccacgacctcgaagcccagcccttcgaagaagcggacgaccttgtcttcccccgccttctgatagggggtcagcaccgccagccggcggatgtcgccatgggcgcggatcgccggaccgaaggcatccgacgcgagtgtcacgtcgagcccgcccgaccgggccgccagtcccgccgccagccgggccgaggcctcggggccgtcccagaaggtttcggccgacatgcccatgatcagggcatgggggcggcaggtgatcacccggtcgaccgccgccatcagctcggcctgcacccgttccatcaaggcggcgaaatcggcctcggtggtcagcggccggtcggggatgtggatgcgcgagacatgattgctcaccccgccggggcgcatgcgggcgaattcggtctgcaccaccgtgttggtcgacggcaccatcacgccgaatttcaggcggcgcccttcctgctcgaacatctccgctcctctctgcccggcggctgcccgatcggggcccgcccatgacgccccttgcgcggcgcttcgtcccggctatgctacacggaaaatttgtctggacaaataggtgatctgcgacgaccatccagccgatcaccccagccgccggagaccgtccttgtcccaatccgcacgccgcagcctgttgttcgcccccgcgacgcgcccggagatcttcgccaaggccctggcctccggcgccgacctggtctgtgtcgatctggaagacgccgtcgcccccgacctgaagccggccgcccgcccggccggcttcgacttcctgcgcgccgccgcaggcgacggcgccggcgggcccgaacggatcctgcgcatcaacgggctgaagacgattgccggcctgcacgacctggccgcactcgccggtgccgggattcccactggcatcgtgatgctgcctaaggttgaaagcgcggaggaactgcgcctcgccgatgcggtgctgaccgaagccggcagcgcgctgaagctggccgcgctggtggagagcgtgcgcgggatcgaggccgcccatgccatcgccgcggcaacgccgcggctcgacctgatgatgttcggtggggctgatcttgcggccgaactcggcacccgggtggcgcccgagccgatggcctatgcccgcgtccggctggtccaggccgcacgcggcgccggcatcgatctgatcgacgtgccggcgctggatttccgcaacccggatgccgtggctgaagacgccgcccgcgcccgggacctgggcttcaccggcaaggccgccctgcatcccgccaatgtcgccctggtcaatgccgccttcaccccggccgaggccgagatcgcctgggcacgccgggtgatcgaggccttcgaggcctcggccggcggcgtcgccgtgctcgacggcaagctgatcgagaaaccggtggtcgcggcccagcgccgggtgctgtcgcgcgcccgggccgccggcctgctcgctgcctgatccgcccttctacagacacgctttacctccagagacgagaacggagacctccccatggtgcagactcacgtcgccgtcggcgaaaaccgctaccgcgaaagcttcggccgctatttcgaggatttcagcgtcggtgacatctacgagcaccgcccgaagcggaccatcacccagaacgacaacatctggttcaccctgctgaccatgaacacccacccgatgcatttcgacgaggagttcgccaaacactccgaattcggccagtgcatcgtctgctcgcccttcaccgtcgccctgctggtcggcatgagcgtcaccgatgtcagccagaaggcgatcgccaatctgggctggaaggaaatcaaactgactcatccggtcttcgccggcgatacgctggaggcggaatcggaggtgctggacaagcgcgagagcaagtcgcgccccaatgccggcatcgtcaccgtgcgcacgcggggcatgaaccagcacggcaaggtggtctgcgaattcgaccggaccatgctgatcgcgaaaaaaggttacgacgtggaagagaaggctggttactgaccggtttcgcatctcccccaagtcgacccgccggtgaccacccgtcattcggacacgcgaagggcgtatcattggatacgcccttcgtcgcatctatgacaccggaagaacatcggtcgatgacatgcaggcagactagcatccatctgtcgcagccccctccctctcgcggccctctccgtctcgcgaggctgtcccagatcatggatgtccaggatgcaggaagtcgacaccaccacgctcacggccggcttcgtaccgctcggcacccttcagccggtgctgccggccatcgaggaatgcatcacccgctggcgcaatgacggacgtctggacggcctgctgcgcctgggcgcggaagagcttctggccctctgtcgcgacgatcttcccgccgattatctgcgcttcctgagcgaggccggagccgggccgctgccggcggacgggctggtcatgttctgctgcccgctcgatttcgacgaggtctatggccgggaggatggcgggcgttatgccatctttgcaaccgatgcgggcggggcctgctatgccttcgaccgcgtggatgcgctcgccgtcgtccggattccggccacgggtgagccgatcaccccggtgggcggggacttcacggcctttctgagcggcctgctggattagtctaccatttttatcgactgattatttgtcaggaccagcagggcgcgctatgcttccttcataatgccggccgcatcccgggcgatgcggcagaccggattggaccggccggccctgggggagaaccgcgcaatgaccgacgatgccggactgcgcggcatccggacgctgatcctggatgccggcccccatgccagtacctccggacgcctgctgcgccgccttgccgtcgaggcaggcgaggcccgggtgctccgccttgccgggacccatgacgacatgctctccagggtctgccggatggtggctgccgcaccaggtgtggtgatctgcggccataatcttggggcggcccttgccttgcatctggccgatcgcccggtcgcccgggcggtgggcggactgctgctgctcgcccccgccgatgtcgaacagcgccccgggcttgaagaccatggccccctgccccgcggccagctgcccttcccaaccatcgtcgccgcccggccgggggacccctggatggatgacgcccggctgaagcggctggcgctctgctggtgcgcggaacgggtggagcttggcggcgatgacgaccggccggcgctgcgccgcctgctccgccggctgctgctgcgcgcacggatcgaccgcgagggcccgcccgccggccgtccgccactgatggccgaagacggcccgcccgcccgcggctggctgatgtgagccccgcttatagtcctgcgggtccggtaaagtgccgggtgttccggccgatcgccgcccgcgccgccttcagctccgccttcgccaccgtctgcagatgcacctcgtcgggcccgtccagcaccctgagcgcccggccccagctccagagcccggcaagcggcgtgtcgggcgacaggcccgccgcgccgaagacctgcatcgcccggtccagcacccgggtctgcagccgcgcacttgcaagcttgatcgcagagaccgccgtgcgcgccgccgcattgcctttcgtgtccatcagccaggccgcctgcatcaccagcagccggcactggtcgatctcgatccggctttcggcgatccactcgcggatattggcacgatcggccagaggtgtgccgccgatccggcgttccagcgcccgctcggtcatcagctccagcgccagttcgcactgacccaccgaacgcatggcatgatgcacccgcccgggccccagccgggcctgggcgatggcaaaggcgtcaccctcggccccgatcagatgtgccgccggcacccggacattgcggaacacgatctcgccatgcccgtctgccgcatgcgcgcccatcagcgtgatgtcgcgcacgatcttcacgccggggacgtcgatcggcacgatcacgaaggaatgccgccggtggcgctccgccagaccgtccgggtcggagacgccgaagacgatggcgaaggacagatgcggatggcgggtgccggtgatgaaccatttccgcccttccaccacgtaatcgtcgccgtcccggcggatggtggtggcgagcgaagtggggtcggatgacggcgcatccggctccgacatgcagaaaaccgaccggatctcccccagcagcagcggatccagccagcgcgccttctgatccggcgtgccgaacagctgcagcagctccatattgccgctgtccggcgccgcgcagttgaacacctccgaggcccaggggacccggcccatgatctcggccagtggcgcatactcggcattcgacagcctgacccccggctgatcgtcggtcagcgacggcaggaacaggttccacagcccggcctcccaggctcgcgccttcagccgttcgatgatctccgtcggatggccgccgtcgaggaaggcccgcgtcaccgccccatgggccggcaggatatagtggtccatgaaatccgtcagccgctggcgcagcgcttcgacatgaggcgggtggtcaaactgcatcttgttgttctttctctcgaccggaccagggcagacatcattcatacgttcgtttgaattgaagatcgcatatggcctgcccgaggtcaaggcgcgccgcagatcctggaattcagggcacagatgatgtgcccgcaccgccgataccggatcccggcgtccaggcccatctggcggggtgagacagtcaccctgatggaaggacggatcgatggagcatcgtcagctgggcgcttcgggcctcaaactgccggttctggggcttgggacaggcaccttcggcggtagcgggccgctgttcggcgcctggggcaataccgatgtggcagaggcccggcggctgatcgacatctgcctggaggccggcgtcaccctgttcgacagcgccgatgtctattccgacggcgcctcggaacaggttctgggccaggcgattcgcggccggcgcgaccgggtgatcctgtcgaccaagatgggcctgcccatggggcccggtgccaatgacgcaggcgtcggtcgcgaccggctgatccgcggcgtggacgcggcactccgccggcttgggaccgaccggatcgacatcctgcaactccacgcccatgacgccgccaccccggtggacgaggtggtggcgacgctggatgacctgatccgcgcgggcaagctgcgccatgccggggtctcgaactatcccggctgggccttgatgaaggcgctggcggccgccgaccgcaccggccgcagccgcttcgtcgcccatcaggtctattattcgctgatcggccgcgactatgaatgggagctgatgaagctggggcaggatcagaaggtcggcgccctggtctggagcccgctcggctggggccggctgaccggccgcatcggccgcaaccgtccgatccccgccggcagccggctacacgacaccgccgccttcgcgcccccggtcgacgaggccctgctctaccgcgtgaccgacgttctggacgagattgccgccgagaccggacgcacggtgccgcagatcgcgatcaactggctgctcggccgcccgacggtcacctcggtgatcatcggcgcgcgcaacgaggcgcagctgcgggacaatctgggcgccacaggctggcagctgacccaggaccagatcgcccggctggatgcggccagcgtccgggacgccccctatccgcacttcccctatcggcggcaagaggctttcgcccggctcgatccgccggcggtttaaggcaacagccgcttctcgtaacgccagaccacgatgtcgaacgggccgtctgccgtctgaagctgcataggcgtggtcgcagcccgatgccagccggccttctcgtaaaagcgggcggcacggtcattccccaccacacaggaaagccaggcgatgtccactccagacgcggcaagctgcgcctccgccgccaacatcaacggcatcgccagaccatggccgcgcagggcgggatcgacatagaactggtcgagacaggcacccttcagccagaaaaaaccggcgggggcgccgtctggcccggtcacctgcacttcgcccgccggtgccgcctcaagccgggccacgaaactctccagccgccgcgcccggacaagaccctcggacgccgacgccagatgcccgtcgcaccagccctgatgccagagccgggcgagcgacgggatatccgccggggcaagcgggcgcatcggcgccggatcgagatggcggaaagcctcgacgggggcggtcataaaggggcatctcctcgcggcagctgcacctctctgcgagaggccctcttccgagaatagaatgccgccggtgcaaggtgaagcgccgggggcggaacggcatccgctccccggcgcttcatttcacctcttgtacctgatgtcaaaagccgacccgatcgatcgtgatcggatcgtagcgggcgacatggtgcttgtgcggcggcgtggcgagaatgtgccgcgcccggtcatcgagcccgtcggtggcaagccgccgatgctgcgcgaggaccacttccagcgccgtgacgaagtgttcgtaatagttccactgctcgggtccgaacccaggattggccgcctcccaattgcggatggcatcggtcagcgcttcctgaaattcgccccaggcgaattcgcccgcctcgcaggcggcaatggcgatggcgaaggcccgcaattcccagggcttgtcgaagggcacctgcccctcgcgccgctcaagcagaacggccagatcggtgctgcaacttgtcgatacaggcatcatctgcgatgtcccttgccggtcgttcaggccgcccgggggaagccggtgccgatcatcgaatcccgggtaaccagggccgcaagctcgtcagcccccatcccgtcggtgcccgcggggcgctgcggcagcacccagtagcggatttcggaattcgaatcccacacccggatctcggtttcctgcgggatgtcgagccggaaatcctctttcaggcagaggcgcggctcgcggatgatccgggcgcgatagggcatcgacttgaaccagttcggcggcaggccgagcacgggccagggatagcaggagcagagcgagcagacgacgacgttatggatcgtatcggtgttctcgacgacgatcatgtgctcgccctgcaggccgccgatccccagttcgtggcaggcggcactggcatccgccagaagccgggccttgaactcgggatcggtccaggccctggccaccacagaggcgccgagccgcgggccgacctcgttttcatagacggcggcgaagcggtcgacacccgcttccgacatcagcccgccttcgatcaggatggcctcgatcgccttcacgcgggccgcgatctcttcctcgctgcggggtgtgtagaccagattgactcgggtcatgcatcgtcctcccttcaggaccgcgccagggtgatgtagggctcccacatgtcgacatgctgacatgcgttgggatcggcatgttccgccccgtagagttctgactgggcgaaacggacggtgtagagatgttcggcggtctctccgccaccggcggcggtggtgtcgggaaagacatgggcgccgtgatgcatcacgatctcgccgacacgccccatggcatagcggggccggcgatggtgatggcggggcaccgaggcatcgacgacgactttgtccccgatccggaatttcggcgccgtctcgatctgccgggcggccgggaagccgttctggatggcccagttggcgaagtcgacgagggccgggtcgtcattcggcggcaatggcgcatccggatactgaagataataggccgtccgcttgtccagctcctcgcgggtccaatgacccttttcgcagccgatccgttcgaccgcatccacccaatgctcgtaatagaaggcggtgaggtaatggagcgggtgcatcccctccagatgcttgcggaattcgtccaggccgaacatcccggcccgggccgcgaaggggaacagcgcccaggccgccttttcccattcggcatgatagggcggctcccaggcggtgggcccgaccggccccatcccgtcgataccgccgaggtcgtgaataccgttcatagctcatctccctgctgcaggaccggtcccgggaccatcaggccggcgcatggaggcgacgctccagcagcatgccgttgcggagcgacttcgcgagcgccagcacgcccagatcgatcagaggttcggccagaatgaccgccagataggccgccccgaaggccgagaccgactgcagaaccgaaagctcgacgccctggccgtaaaacacccagaacgccacccacgagacgatgccggcctggtaggtagccgaaagcgcgagcacctgacgataggagaggtcgacatagggcgtgcccggcgcgatcagacgccgcgcggcccaggacagcgcaaagagcggcaccagaagcgtcgtgacgttcatgccgtattgcggcaggtcgaagggcgcgaagagcagcccctgtaccagcagccccgatgccaagccgatggccgcaggggcgaggccgaacatcagaaacagcgtggagccgaggatcagatgaacctccgacacgccgaccgccggatgcggcagcagctggaaaagaccaagcacgacggccgccgcgatgccgctgcgggcagcgagtgacgcgccgccgcggtttctgatctcgtcatagccgaatttgagcgtcgccagcccggccccggccgccgtcgcgtatcccaggatggcctttgcgccatccacgatgcccggttcgatgtgcatcgtccgcctcctgttttttattggagagcacccgcgcgcatgtcatccactcaggacgcgctcttcccccgcgcgccttcccgggatcatggccccggctgccgcgtcgggtgctgtcttattcataattgtcagatgacattattgcaaaggaaatatatttgtatgtcggtggatcacccctgaacatgtggggcgcgccgcagatgagtcccgccccgcccgcagcgccccgcacaggcgagccgacaggccaatcactgaccgggagccttgaagatgattcaggtggtttctatgctgaaaacaaatcagcgggggccggtgaccatgtccaaagtgaatatcggattgctgatctcgcaaagcggcccgaccggtatctgggcgccatcctgtctgaacggcgccatcctgagcgccgccgagacaaacgccgccgggggcgtccatggccaggaaatcaacctggtcgtgcgagacgccggctgggatccggccgtggcggcgcgcatcgcccgggatctggtcgagatcgacaatgtctcggtgatcgtcgccatggtggcatccaatgcccgacggcggatctcgttcgcgatcgccgggcgtgtgcccttcatctatacgccgaactatgaaatggacgcgcccgaaccgaccattgcgctcagcgccaccgatgaccgcctgatcccgcccatgctcgcctggatcgaacagcgctttcgcgcgcgccggttcctgatgatcggcagcgactatcgctggccgcagcggaccatgccgatgaccggccggatgatcgcggcggcgggcggcaccgtggtcggcatgctgtcccggccgctggatgcgccggaagactgggaccggcgcgcggtcgaagacatccgcaaggcggatcccgacgtcgttctctgctttctggtcggggatcagggcatccccttctaccggatctatggcgaggccgggcttgccggcaggatcccgagatgcgccatcgccaccgacgaaaccatcctcaccagcctctcacccgcagcgatggaagggctgttcgccggggcctgctatttcgccgcggcccggactgcgcccaataccgcgttcatggaacgctactggtcgtccttcggaagcctggcgccgatccccaacgcctatgggcaatcctgctatgaaggcgtcagcttcgcgctcggcctcatcggccggtgccggtccgccgaccctcgccgcctgctgagcctgccgccgcatggggtcgaatatcggtccgcccggttcgacaccgccaccggcacgctctcgcaacgcctgccggtctatatcgcggcggcagacgggttgtccttcgatgtcgtcgcccggttctgaggagtctgatatgaatacaccgtcttccggccccgcccgggaaacgacaaggaaacagtgatgtccggcgagtctctccaaacgaccatcggctttctggtcgccaatctgaaccgccagctcgaacgcgagctggaagagaatctgcggccgctgaagctgccggtcgaccagctccgggtccttcagacgctggcctccgacggtgcggccgacgggctcagcatgtcggaaatcgcccgaacgattctgatcgatgcctcgaccctgaccaaggtgatcgatcggatgatctcggacagcctggtctatcgggccgccgatccggccgatcgccgccgggtccgcgtgctgctgacccagaaaggcgccgcccttctgaagacgctgcgcccgatgctcgaccggcaggaggcggagcttcggcgcactttcgacgtgttgatggacgacccgacgccgcggaacttcgcggagttgctggagcatttctgcaagcgaagcgcgccgccggcatagggtcgcccggatacaggcggcgcccgatcagaccccttccaccatcagcacgcgatagtcggccgcccgatagcgatggccgcgggcctcggcataggccgggctgtcataccaggcgcgggcggcatccatgtcggggaaggacaggatcaccacgccttccgccgccgcaccttccagcacctgatgggggccatagaaggcaagcggggtgatcgggtggtcgccgcgcgcggcacgggcgccggcggcatagtccttgaaggcgtcttcgtcgcgcatcttctcgcggatcatcacgacataggcggtcacggggcatctcctccatgggggtggtctggtttcgacatcaaggtgaccatccgcctgaacccatcggcaaactggcggcgcgcgaccaccggatcggaggtgatcgcacccgacaggtagaacgcgccgaacccgatgcagtaggccagcaggtcggtcgtcatatgccgcagattgccggtctgaagccggccggcctcgacgcattcccgaatggcatcgcgggccacgtcgtaggtgggcagatggatcccctcgatcgggcgccggtccttcagcccgctcagcgtgccggaagacaggaacatcagttcgaaataagcgctcttctcgatcgcgaagtcgaagacgcgggccgccagcgcctccagatggcggaccggatccgcctcctgccgttcgatcgagagatagccttcatagatccggaagccctcttcgatcagggcacgcatcagggcttccttgtcggcgaaatggcggtagatcgccatgggcgacaggccggcccgtttggcgatttcccgcagggaaaccgagcctgcgcccatctccaggaaggcgtcgacggcaatggcgaggatccggctgcgcgtgtccgacggagccccgccctcagtcatgaggcatcctgagcgaaaaccggcgccttcttgatctcatcgaccatgtccctgccagtgacggcagaggcacagagcacaccgccgaacaacgcgccgatgatgccgtcgctggtcacgtcctgtccagtcagatacaggcccggtacgggggtctgcgcccgcagccagtcctgttcatagcgctgcggcgagctttcgatccccagaaaatcgccgtattgctgacggacgaaggtctcgtaggtcagcggggtcgagacctcgacatagcgcacggcaccgcgggtcgcaggtaccaggcgatagagatcggccaacaggcgctcctgcaccttcgccttcatcgcctcgtaatcggcgccgcgcttcatccaccgcgtaccctgccagggggcgaagtggcggtagtcggtcagcgcgtgcatctcgatcgtcgaccggttcgggaaggtctcgttccatgtcgggtccttcgccgaggcgaaggtgatgaagtgaaacggaaacggcgcatcgaaatcgacacggtgcgccgccaggttggcgtcgaaatcggtccccggatgcgcccagatattcgcaggctccagacccagcgtcgccgcatccccctccagcccgatatgcagcccgaccacggtattggtataggtcacgctctcgcgcatccggtccagcccggccgccgcacgcgcctcgggcgccatcagccggccgaaggtgttgcgcaggccggcgccgctgatcacgaccccggcgcgcacctcttcccccgatgccatcacgacaccggtcgcccggccgtcctcgaccaggatgtgcgccacctcggcaccatgcaggaccagcccgcccgccgcctcgatcaccggcacgatcgcatccgcaaaggcccggccgccgccatggggatagctggcgccgttcatatagtgcttggccagcatggcatgcatggcgaaggaactgcgcgcgggttcgatgccgtaatcgccccagttggcgcaaagtaccgcggtcagttcaggatccgaggtcaggtcggcgatcacttcgcgggtcgtgcgccgggcgaaatcatggaaggggccggtcatcgcttccagcgccggcatcggccggtctgccggataagccttcagagcgaagaagggggccgaggacttcgatgccgccgccagaagctccagatagcggtcgatcgcggcatgctcctgcgggaaccagccgtggagcgcggcccgataggcctcgactccggcgggaatgcgatattcgcgcccggcaatgttcatccggttgtagatcgggggcagatgcgcccagcggatcccaccccgggccgcgtagtcgaacatcttccaggtcagcgtccgtggcgatgcgacgtcgccgatataatgcatgcctaccgtccagcgatacccggcccggtcatagctctgggtcaggccgccgatcacggcgttctgctccagcaccagcatgcgcatcccctgctgcgccaggacggaggccacccccagcccgcccatgccggagccgatgacgatggcgtcgaagccatgaggaatgccgtccttgcgcctgtagggccgccctttggtgtacatgcatcctcccgattcttttgtttatgcttgtaaactatcataccgggccgcttggacaagtcggattctgaaatccggcatctctgtcctcatccggtcaaattccgcagacagattatcgaatggcggccggttgcatagtatacgactgtacactatgactcgatcggaggaaacctgaagccccacacagaccggacagaaaggacggcccagagatgtcggaccatcagccgagcccgaccatgaccatcaacggtcatggcgtgacctcatcccaggtgatcgaggtgatcaacccggccaccagcgaggtcttcgccaccgccccggactgcagccgcgagcagctggacgcggcggtcgaaaccgcgcagcaggcctgggaaagctggcgccggaccccggtggccgagcgccaggccgccgtacgtggcgtcgcccgtgtactgcgcggccatgccgacgagctggcacgcctgttcaccgccgaacagggccggccgctgaaggccgcccggcaggaaatcaccggcgccgccgactggctggatgtcgtggccggcatgaccccgcccgagcatctgaccgaaatgccggatggtcagcgcatgcatacccgccatgtgccgctgggcgtgatctgcgcgatcgcgccctggaacttcccggtcagcctggcgatgtggaagctgggtcccgcgctggtggcgggcaacaccgtggtgctgaagccgtcgcccttcaccccgctctgcacgctcagaatcggcgagttgctgcgcgacgtgctgccggcgggcgtgctgaacgtgatcagcggcagcgaccggctgggcccctggatgaccgcgcatccgggtttcgccaagatctcgttcacgggatccaccgccaccggcaaggcggtgctggccagcgccgccgccgatctgaagcgcgtgaccctggaactgggcggcaatgacgcggcgatcgtgatgcccgatgtcgatgtcgacacggtcgcccagaagatctttttcggcgccttcttcaacactgcccagatctgcgtcgcgaccaagcggctctatgtccacgaagacatctacgacgcactgcgcgaccggctggttgcgatcgcccgatcggtgaagatgggtgacggcaccgaacagggcacggttctggggccgatccagaaccggcgccagttcgaccgggtgatggagctgctggacgacgcccggcggaacgggctgaccctgcttcagggcgcagacgtgcccgcatcggggtatttcatcccggtgaccatcgtcgacaacccgcccgaggcatcgcgtgtggtccaggaagaggccttcggcccggtgctgccgatgatgcgcttctcggatgtcgacgaggtgatcgcgcgcgccaatgacagcccctatggcctggccggcgcggtctggtcggcggacgaggtggcggcgatcgccatcgccgaacggctggagaccggcaccgtctggatcaaccagaacctcaacatccgccccgacacccccttcgccggccacaagcagagcggtttcggcgtcgagaacggcatggaaggactgctggaatataccgtgccgcaggccatccatctgccgccgctcgcggcgcggcgcggcgggtcctgaacggccggcgatctttggaaaaggcaggggccggccccgaaggaccggcccctgccctactcgttcagatcgacccgttccgggttctggtgcagatgcgcaggctttgtctgttcagaaggtcttccagtcgcccgccgcctcgaaggcagccgcggcggcatagatggtgctctcgtcataatccttgccgaccagcatcatgccgaccggcaggccgtcgatcagaccgcagggcaccgtcatggccggatggccggtcacgtcgaactgctgggtgttgcccagcaccgagaaggcggtggtgatgatctcggtcagcgaggcgtcggcggccgggatggccggcgccacgatcgggcaggtcggcatcagcagcaggtcgtactcggcgaaggcggcgtcataggcggccttgaccttgcgggcgatgttctgggccttggcgtagaagcggccgttatacttctggatgaagtactcgccgatgaacatcgagatcttcagcgagggcgacagctcgtcggcacgctggcgccagccgctatgggcatccagcaggccgacattgtagagccccttccagttcatgcccatgccgttgccggccatcatctgccactgcagaccttccagcgcgatcggcccccagatcaccgcggcggtgtggtgctcggggatcgagatttcggtgagcaccgcgcccgcctcttccagcttcttcgccgcggcgcgcaccttctcgtaaacggccggatcgccgttcgcgacctcgaacccctccttcaggatggcgatcttcatgccctggacgcccttgcccagcgcctcggtatagggcgcggtcacaggggcgtactggcgcggatccagcccgtccgcaccggcgatcacctccagcatcagggcgttgtccgccaccgacgaggtcatcgggccggtgtggtcgatggtcgcctcgatcggcatcacgccggtataaggcaccagaccatgggtcggcttcatgccgtaaagaccgcagagggcagacggcatgcggatcgaaccgccctggtcgccgccgatcgccatgtcgacctcgccgcaggcgaccagcgccgcactacccgacgacgagccgcccgcgatatgacccatcttataggggttgtgcaccggcgccggcgacgaggtgtggctgccgcccgacaggcagaaatactcgcaggtcgccttgccgacgatggtggcgccttcgtcgagcatgcgggtgacgatggtcgcatccagcgccgggatatagccttccagcgtcgaggcgccgttcatcatcggcacgccggccagcgccacattgtccttcagcaccacggtcttgccggcgagcttgccggtggcggcacccttcacttccgacttcacataccaggcaccgtatttgttctcagcgccttccggacggtagccgggggtgcgggggtatttcacgaccgggatgttgtcgggcatcgcgtcgagcgcgtcataggcggcgaaattgccggccatcagggtgagatactcggccgcctcgtcggcggagagcgtcatgccgagatcggcggcgaggtcgatcagctggtcggtattcgggcgggtgacggacatcttggtctccgttgtccttgaacgtgaagcgaaagacaaagggggagcggcccggcgcagagtccctgttctcgcgccggcggtctgcatgctccccgggttctggcccggtcgtctcttggggaaaatcgggcgggggccgtgggtgtggggggactggtggtccgaggtctcctgtcggtcaggcgtgcatgccgacgaaatcggcgatgcgctccggatccgccatcagctccggcgagacctcgtcggtgatcacccctttctggatgatcagcagccggtccgagagggcggtcaggaattcgagattctgttcgaccaggatcatggcgatcccggtctggcggcgcagttcgtgcagggtctcgacgatctcgtccaggatgttgggctggatgccctcggtcggttcgtcgagcaggatcatgcgcggttcggtgcacaggcagcgggccagcgccagcagctgctgttcgccgcccgaaagtgcgccgccgcgccggtcgagcagccgggtcagccgcgggaacatggtcagcacccggtcgatgacctcgcgactttcccgcctcttgccggcctggcccatgcgcaggttttcgtagaccgacagatccgggaagatctggcggccctgcggcacatagccgatgccggccgcagccttggccgccggcttcgcggcggtgacgtcgcggccgtcgagcacgatccgcccaccggtcgccggcagatagcccatcagcgtgcggatcagcgtggtcttgcccatgccgttatggccgaggatgccgaggaattccccggcgctcagggtgaaatcgacgcccatcaggatcgggatccggccatagccggatttcaggccctgaacctccagcaatgcggtcatgtcagtgcaccttcttgccgagatagacgtcgcgcacccgctgatccgccagcacctgatcgacccccgcctcgaccagcaccttgccctgattgaagacggtgacggtcttggcgatcatccggatgaactgcatgtcgtgttcgaccacgatcagcgccttggtccggttgatgtcgcggatgatctcggcggtgcgcagcacctcgtcatgggtcatgccggcggcgggctcgtcgagcaggatcagctcgggatcgcccgcgatcaccatgccgatctccacccattgccgctgaccatgggagagccggcccacctgggcatcggccagttcggtcatgcggatccgcgccagcacctcgtcggcgacgtcgcgggccttgcggtccagatgctggcggcgggcggcgagccagacatgttcgcgcaccgagagcccgtcgaagacattgggcacctgggtcttgatgccgatgccgcgccgggcgatggcatggggctcgtcacccgcgatcggcgccccgcggaaggcgatcgcccccgtcgagggcttcaactggccggtcagcatcttgaagaaggtgctcttgccggcgccgttggggccgatcaggcagcgcaattccagctcgcgcagggtgaagtccacctccgacaccgcgaccacgccaccgaagcgcatggtgaggtcgcgggtctgaagcaggatgccgtcggatggggtggtttcctggatggtcatgtcacttcgccccctcgacagccgtggtttcggtgacggtggcgtcggatgcccgggccctgccgggcagcagccgcatcaccagcccgaccagccccagccgcatcagcggcaccagacccatcgggatcgccatcacgaagccgagcaggatggcccccatgaccagatcggcgttgaaggtctgctgggtgccgatctgcatcaccagatactgcatgatgaagcagccgagcaccgggccgaccagggtgccgaggccgccgatggtcacccagatgatgatctgggctgccgtcgacaggctgaacacggtggggctgacgaaggcgccccaattggtgaacagcccgccggccagccccgccaccgcaccgccgaccacgaagaccatcagcttgtagatccgcgggtcgtagccgagcagcgccgcccgggtctcgttctcgcgcacggccaccaccacccggccgaaatgggtgcgcagcagccctttcagcgccagatagaccagcagcaggcagccggccgagagataccagttctcttccggcccgaagaagaagtcgggatcgccgggcatcgacaacccggggactgcgggaatgccattgaaaccgccgagcgccgcattgccgatggtataggcatcaccggcggtgctgttgaccacgttgaacaggatcagcgtcaccgtcagcgtgatgacacccagatagacgtcgctgatccggccgtagaacatgaagtagccgagcacggcggcgaacaccgccggcaccagcaccgccaggccgaccgcggcccagctgccgtcggtattgatcgcggtcaccgcgaatgtataggcgcccaggccgaaaaaggcggtctggccgaaggagaggatgccaccgaagccccagatgaagccgaggctgagcgccagcacgcccatcaccacgaagatcgtgtactgcatcagatcgaacagctcgaccatcgccggcatgaacacgatcagcagggcggcgatgagaacgccgatggtctggccggctttggagacggtccggatgtcgaggcccatggatcagaggctccccctgaagaagcgcccggagatgccctggggcagcaggcggatcaggatgatggcggcgacgaacaggaagacttcgccgatcaccggggtggtgagatacgaggcggtctggttgatgaagccgaacagacccgaggcggtggcgctgccggcgatgatcgaggtgccgcccgcaaccacggtgatgaaggccttggcgatataggccgcccccatggtcggcagcacgcccgccaccggagcgagcagcccgccggcaaggccggtgatggcggcaccgaggccgaaggtcgccatatagacccggggcgggctgacccccatggccgccgccatgtcggggttctgcatggtggcgcgcgcgatcaggccgaagcgggtgcgacgcatcagcagccagagcccgccgagcagggtgatcgccaccgccaccagaaagacggtgtagaggctgctgcgataggcgccgatggtgaagccgcccaaaggcgacggcacgctcttgatcgtgttgccgaagatggtggtgatcaggccgacgaggaacaggctcaggccccaggtggcgagcatcgaatccaccagccggccatagagcaggcggatgaaggtccgttccaccagcagcccgaccagccccacgaagaccggcgagaccacgagcatggcgatccagatgttgatgccggcctccaccgccaccacggtggcataggcgcccagcatcaggaattcgccatgggcgaggttgatgatcttcatcatcccgaagatgacggcgaggccggtgcagagcaggatcagcgaggccacgccgttcagcacatccagggtcaggacggctgcgagatccatgagcctgtcccccgggtcagagcgagatcacatactgcttgttgtcgttcggattcttgaccagatcgcagaccgcggcggtatccgaaggcttctggtcgggatagctcgccaccacgtcccagagcttgtccttcgcctcggcgaggaaggcgttgcgcaccgaatgatgggtcgccttgtccagcgtgaccttgccggtggggccatcgaagctgagcccggtctccagcgcctcgatcaccttcatgcggtcgatcgacttcgcctgctgcgccgccttcacccagagatggaagccttcataggtgccggccgccagttccgagatataggggatgccggggaacttctccttgagcgccgagacgaatttcacgctggcatcggtcttcagctcttcgtaatagccatagcccgagacgatgccgttgctttccgacggctccagcgccgccaactcgttgaccaggccgaaagtggtcgatgagatcgggatcgaccccttgaggccggccgccgcccactgacggtagaaggcggtatggttgccgccgaccagggccgagaacaccacatccggcttggcctgctgaatcttgctgatcgtcgagccgaaattggtcacgtcgagcgggaagaagtcgatggccagcacctcgccgccattgtcgcgggtgtacttctccatccatttggccgtgatctggccgtaattatagtcggccgccaggatgtagaccttcttgccccagcgctccagagaatagggcaccagcttttcgaccgtctgggccggggtggtgccggtgcagaagatgttgcggtcgcagacgccgccttcgtagagcgtgttgtagaaatagagcgtcttgtagcgatcgaagatcggccggatcgcttcacgcgaggccgaggtgatgccgccatggatcaccgcgaccttgtccttgagcgcgatctgctgggcatactgggtgtagagctgaatgttcgactgggtgtcgtaatgcaccagcttcagcggccggccgagcacgccgccggccgcgttcacctcttcgatgcccagttccagcgcccgcaccatcgggacgcccgaggtaccgaccgggcccgactggtcgtgcaggctgccgatcaggatcggatcctcggagccgagcgcagcgtggcgcatgatcatcggcgccgcgatcagcccgccggtcgcgagtgcggtgctgcggagaaaactcctgcgggtgaagttggtccggtcgttggacatgtgtcggctgctccctgccaatggccgcctttcaggacacgctccccgtgtccctcgacgactccctgacaggcatttgaaaacgagcttattgaaaagtcaactatatgacgcgctgcaaaaatgatggatgatcagaccaggaccggcggcgccggccggcggggaagcccccggggggctagcggccggcgctgcggaacgcggtctcagaaagacgcgacatgtttgaagtcgataccctgcacggtggcgatatggacatgactcggcatttcaaggctgtcctcgctgcgcgccgacagatgcgccagatggaaccggtcgcgccgcttgaacgggccgtagccgcggggaaccgcatcgaccaggcttttcaggaagtgcacgccctcgtagcacgactgccccagcatgttgggcaccggcgagcgcgccccgaagagcgccagatagcggtccaggaagcggttgttggcgcgggtgtcgagattggcgaaataggccgagacgctgtagagccgctcggtgttttcctcacccaccgcatagagcaggttctcgtcgaaggcgaggcagagccgcgccgcccgtccggccatgcccgcctcgccgaaggcgcggtggaacatgatcgcgtcctcgcccagcagcatcaccagcacgccatcggcgccgctcgcccggattgcggccagttcctccgaaaagtcggaccgttcggaatagagccaggggacgtagcgctcccccaccagccgggcaccggttcgtgccgcgagcgccttgaccagcgccgccgagcgccggggccagacatagtcgttgcccaggatgaaccagcgctgcacccgttcatgctccgctacccagctcatggccggcggcagcagctcgcggctggtctcgccgatggtgtagacgccgggatggcgttcgccgccctcgtattgtggggtgtagacatagggcacgcggccggcgatggaggcggcgatccgcgcccgcagatcgctgggatgcatcgccaccaccgcatcgatgcgccgttcggccaccgccttcgacaccctggcggccacctggtccggcggcagaccggcatccagcacttccagcgcgatttcgtgcccgccaatgccgccggcggcattgatctcgtgcaccgccagccgggcactggtttcgcaggacggtccccagatgccggcgggaccttggagctgaatcagcagtccgatgttcatcggcggaactccctcgattgccagtcaggccctgaaacggcggcgacttttcttggatttttcggtcgccggaccgcttccctatcccctgtcgttctcgtccgcggcgcgcaaagcgccgcggtcacttgcacagacatgtcgacgtcggataaatgatcgcgcgcgttcccccgtggtcccacccgacacgcgccggaaagagggtgcagagtcttcgtgccgacgtccatcgaacataacgtggcctacatcgccgcccgtgtcgcccgccatctggagcgggatctggaagaggcgttgcggcccgaaaagatcccggtctcgaccgcgcgcgtgctggccctgctcgccgacgatcagggccggccgatgtcggaactggccgatgcggtgctggtcgatccgccgaccatgaccaagatgatcgatcgcctggtctcgcagtcgctcgtgttccgtgcccccgacccggatgaccggcggcgggtgctgatcttcatggccccgcgcggcgaagagctgtggcagcgcatcgcgccggctatcgcccgccagcagcagcgcatcgaagcggcgatgggcacagcggatctcaaccggctctgccgcatgctcgacgatctgacccgcgcctgaccgcatcattccgccccatcctcgttcagcagaatatgcttggccaccgaatactggtcgagcgcatggatcgacatgtcgtagccgaagcccgaccggcggcggccgccatggggcatttcggccgggaagaccatatggtcgttgatccacacacaaccataggccagcctgcgacccagccgtatggcgcggccgatatcgcgggtccagatcgacgccgccaggccatgttccgaacggttggcgaagcgcagcgcctcgtccacatcggcgcagcgcgtgacggtcaccaccggtccgaacacctcgcgggtgacgatctcgtcctgggggctggtgttgacgatcagggtcggctcgtaaaagcagccattgcccggcaccacccggccgccggcgacgatttcggcggtgccggccgcgcgggcgcgttctacatagctcgccacccggtcgcgctggcgcgcagaaatcagcggccccatctcggtcgccgggtcgaagggtgatccgatgcggatcgccgccaccgcctcggccagccgggccaccagccggtcatggatgccgggcgccacgaacagccgggccgcggcggtgcagtcctggccggcattgtagaagcccgcgcggcggatgcaggccaccagccggtcgacatcggcgtcttctgccacgatcaccggggcgttgccgcccagttccagcaggctgcgcttcacgccgaaggccgccccgtccagcaccttgcggccggtgaccagatcgccggtgacggtgaccagcgccacgcccggatggcggaccagggcctggcccaccacttcgcccgatcccgccacgacattgagcacgccgggcggcagcaggtcggccgccagcgccgccagcgccagcaccgagagcggcgcctcctcccccggtttcaggacgaccgtattgcccgccgccagcgccggcgccagcttccaggccgcgatcatcagcggatagttccaggggatgatcgccgccaccacgcccagcggctcgcgcagcagaatgctggtccggccgggcagataggcatccgcggccatgtcggtgcgggtgcgggcggcaccggcgaagaagcggaagacatccgccgcccgcggcagttcaccatcgcgcgacgccgacagcggcttgccgcaattgcgcgcctcgatcccggcaagcgacggcgtgtggcgatctatggcatcggccaccgccagcagggcgcgcgcccgctcgccgggggtgagcgccgcccagccgggtgccgcccgctctgccgccgccaccgcctcgtcgacctggaccagggcggcatcgcgcagcgttgcgatccccgcaccggtcgacgggtcgatcaccatgcgctccggcccctcgcccgccaccagccggccggcgatcaacaaggcggtgttgtcgatctgccccgccggtctcatgccgtcatctccccggcgcgatggcccggcctctggccctggcggcaggattgcaggaaatgctccaccgccggcatccgctccagcccgcgccgccagaccacgcccacatccagcgccggcagcggatcggcgatcgcccgcacctccagccgatcgccttccagcgaccagggccggtaggcgagatccggggcaatggcgatgccggcgccggtggcgaccatgctgcgcaccgcctccaccgatccggtttcgaacagcacccggggggtgagcccggccctgcggaagatccgcgccagcgcgtcgccgtaatcatccgcactcagcacgatcagcggttcctcgcagacgtcgaacagcgtcacccggtcgcgcttcaggaagcggtgattgggcggcagccacagccggttctgcgaccgggccagcacctcatgcgccagcgcagccttctcttcgatttccgagacgatcaggatcgcgacgtccagctcgccattgatcagcagctgttcgatgaacggccggcggtcctccgagggcgccacctcgacccccggaaaggtgcgccggaaacgcgccagcagatcggccaggaaatagcccgccaccatcggcgagacgccgagccccaaccgcccggtcagcttgcggccggcggccgacagcgtgcggccggccgcggtcagcgcctcgatcatcgcatgggcgtggcgcaggaactggtgcccttcatgggtcagcgacacaccacgggggtgccgctgcagcagtggcacccccagctgatgttcgatcgacttgatggcctcggtcaccgccgattgcgacacaccgaccagcgcggccgcccccgtcaccgaccccgcttccgcggcggcgacgaaatatcggatgtgacggaaggacaggtccatgacgcgatggtcgcctttccggcccggtttcccagggtggttctccccggggtggcagaggtcagccgagcgtcacccagacgctcttggtctgggtgtgggcgacaacggcctcgaaacatttgtcgcggccattgccggtctgtttccacccgccccagggctgggtcatgtcgccgttcatatagccgttgatccagaccatgccgcactccacccccgccgcgaaacggtgggccttggtgagatcccgggtccacagcccagctgcgaggccatagaccgtgtcgttggcgatgcgcaacgcctcgtccagcccgtcgaacgggatcaccgcgcccaccggaccgaagatctcttcagatgcaatccgcatgccattgtccacatcggcgaacagggtaggtgcgacataggccccgccttcgcaccccggcggcaccatgccgccgaaggccaggcgcgcgccctcggtccggccggtctcgatatagtccagcacccggcgctgatggctgcgggtgaccagcggccccagcgtggtggcggggtcgagcgggtcgccgacatgaacggtctcgcgggtacgggcagcgaaggcgtcgaggacatcgggcaggattgcccgctcgaccaggacgcgggagccggcgctgcatacttcgccctggttgccgtagatgcctgcaaccgccgtgttcaccgcggtttccaggtcgggcgcatcggccatgatcacatggggcgacttgccaccgcattcggtcgagacatgcttgaggttggactggcctgcatattccatcatcaacccgccgacctcgcccgagccggtaaaggcgatcttgtcgacatccatatggcgggccagcgcctgaccggcctcttcgccgaagcccggcaccacgttcaagatgccgggtgggccgccggcctcgacgaacagccggccgagcagcagggcgcttaggggtgactgttccgcaggcttcagcaccaccgcattgcctgcggcgagggcaggcgcgatcttccatgccgccatcatcagcggataattccagggcacgatgcagcccaccaccccaagcggctgcctgaggatgtagtggagggcctgttctcccgttgcggtggtagacccggtgatcttgtccgcggcctcggccatgaagcggaagcaggcgaggctgcccgggacgtcgatggtcagcatctcggcaatcggtttgcccatatcctgggcatccagcactgcaaatgcctcggcatgcgcctcgatcagctcggcgaagcggtagagcacctccatgcgggcacggggcgggatgcgcgcccagggcgccgtgcggaaggcccgccgggccgaagcgaccgcccggtcgatatcggcggcaccaccgcgagcgacctcggccagaaccgcatcattcgccggattgatcgtggcgaagcgggcgccgctggcggcctcgacgaactcgccatcgatgaacaggccggtatcgggtttgagccggccggcgagcgccgtccagtatccggcggtcttcagatcaaagggcatgggtgccgcctcacttggccgaaagttcggtgcaggtttcgaggatcaccggcccgtcgaaatgcggcgaaaccgcggcgaagaacaccgccaccgcctccgacccgttatggcgatccatggccgcgacatcggtgaagcgttcataggtcgtgaaccggcagggattgtcccgcgaccggctgatgaagaagtccaccgtctcgggctcattggcccgaacatgcgccgcaaccttgagcagctcggcctcggcaagcgcttcggcgccgggcgtgacggtgatgatggccgtgatggtgatcatggatctgcaaatgcctcccgcgcaggccgacggatctccccagacccgtcccctgatcagcctgcggccggcgggggcggcatgaccaattcaaaatcccggattgcgctatcggaaaagccgaacgcgctggcagggcctgccgcagatcgatgcatctgccatcggctttgccgataccggacccggcgcgtttcctgttttacagcccgcacgcgcctgcgctctgctggcaggcggccggaaccctgtccggccggcactgacggacgacgacaaggagatggcagacatggcgcgcatgcaggcggcagtggtcgaacggccggatgaggggttgcggatgatggaggtcgcgcgcccggaacccggtccgggcgaggtgctgatccgcgtggcagcctgcggtgtctgccactccgacctgcacatcgtcgatggcgactggggcacgccgccgaaactgccactgatccccggccacgaggtcacaggccatgtcgcggcgctgggcgccggtgtgtcgggcatcgccatcggcgacgcggtgggcgtgccctggatggcccatgcctgcggacgctgcgcctggtgccaggccgggatggaaacgatctgcgaggccggcggcgccaccggcttcagccgcgatggcggctatgccgagtatatgctggccgaggccgccttcgtcgcccggctccccgccgatgccgatctggtggcgatcgcgccgatcctctgcgcgggtgtcaccacctggcgcggccttaagcgatcggaggcgcgggcgggcgagcatgtggcgatcgtgggcgccggcgggctcggccatgtcgcgatccagtatgcccgggcgatggggctgcgtccggtcgcggtcgacgtttcgcccgcccggctggaccatgccctgacgctcggcgccgaagcggtggtcgatgccgcggccggtgaccccgtggccggcgtgcaggcggcgaccggcggcggcgcccatgccgcaatcgtcaccgccaccgcacccgcggccttcgaacaggccatcgccatgacccgccccggcggcaccacggtgttcatcggcctgccggggggcgaacgcgatgccatccgggtgtcgatcgcccgcatctccaactgggaacgctccatccgcggatccaatgtcggcacgcgccgcgacctgcaggaggcggtggatttcgcgctccgcggccatgttcgggcagaggtgacccccctgcccttcgcccggatcgacgaggccctggcccggctgcgccgcggcgaggtgacgggccgcctggtgctgaccatgggcaggtgaagacgggcgcagagagggcttgcacgtcatataagtatctgcttatctatcggcatgaccgagaccgatgtgttcaaagccctcgccgatcccacccgccgcgccatcttcgagaagctggccgcggggcggatgaatgccagcgcgctcagggacggcatggcgatcagccagccggcgatgtcgcagcatctggccgtgctgcgtgccgccgggctggtgcgggaagaacgccagggccggttcgtcgattacgaggtcgatcccgacggtctggccgtggtggcggactggctggcgaagtatcgcgcatactggccggcgcggatcgatgccctgaaggcgctgctgaaggagatggaccaatgaccacccccgcctccacgcccggcgccgatcgcatcgtgcaggattacgatctcgacgccccgccgcagaaggtctggcgggcgatcagcatccccgaacttcgggcacactggctgccggccgcggatctggcggcggccgaaccggcctcggtcacgcccgggcgcgaactcagctatcgcatgcgggaacaggcaccgcccttcaccgaaagcctggtgaccttcaccatcgcccccaataccaccggtggcacccggcttcgggtcgtccatcgccgcatggccgccgccaatgaccgcagcggtccgatgatgcgcgccgcctagacgcggtacagccttccccacattcaaaagagagcggaggtcgccgatgcgcggcacgatgcagctcgtccccatggtcgtggaacagtcgacccggggcgaacgggcctttgacatctattcccggctgttgaaggaacggatcatcttcctgaacggccaggtcgacgatgacgtcgcggcggtggtctgcgcccagctgctgttcctggaggcggaagaccccggcaggccgatcaatctttacatcaactcgcccggcggcgtggtcaccagcggcttcgcgatgtacgacaccatgcgctacatccgctcgccggtgcacacgctgtgcatggggacggcccgttcgatgggttccttcctgctgatggccggcacggccggcgagcgcgcggccctgcccaatgccagcatcctggttcaccagccctcgggcgggttccagggccaggcctcggacatcctgatccatgccgaggaaacgcttcgggtgaagcagcgcatgatccggctttatgccgagcactgccatcgcacccctgaagaggtggaacgcacgctcgaccgcgaccggttcatgaccgcggaagaggcgctggactgggggctgatcgaccggatcctcgaccgacggccctgagggcgcgcgcgacacttgcggcgaccggtttccggtcgcatcatgcgcgggcgtctccgccggccggcgggggccgaaccgcaggaaagtcaggcccccgcccacagatgcccaccactgccggcaagacggccgcccgtcacgacatcgccgccgaccccaatccgtcgctcatggccgcccggcgtgactggcaccggcttcaggccgcgctggcgcccgagatgcgggactggctggccgggctggtcagtgcctcttccgacgagctggcgcgcgatttctacgatgtgctgatggccgatgccgaggcggcgccgctgctgtcgaacgagatcgtccagacccggctgcgcggctctctggccggctggatccgcagcctgtttccggccggccccgcacccgatttcgacagcatggcgaccgtgcagacccgcgtgggcgaagttcatgcccgggtccgggtgccactgcacctggtcagccgcggcgcacggctgatcaaggccggcatcgccggacggatcgccggcagccgggtcggccgcgacgagctggtccgcctgctgctgcatgtggagaccgtgatcgacatcgccatcgagctgatgggcgcggtcttcgtttccggcatcacccatcagagccgcgacgaggaagcctaccggctgttcttcctgagccaggatctgtcgctggaacgcgagagccagcgcgcctcactgctggaatggaaccaggccgtgctgctggcgctggccggtggcagcggttcgaccgagcccctgccccgcatcggtcggtcggatttcggcctctggttccaccatcgcggcggcatcatgttcgaaggcacgccggtgctcgaccgggtgaacgagctgatgcagcgtctggacgagggcatcctgcccgagaccgatgcggcgcgcgccgccggtgacggtttcgggccggcgctggggctgatccaggcggcggtcaacgagatccgcttcatcctgaacgacgccttccaggccatgatcggcgccgaggccggtcgcgatgccctgacccggacgctcaaccgccgcttccttcccgcgatcctgaagcgcgagatcacgctggcgatgcgtcgcgaccatccctttgcggtcatcatggtcgatctggatcatttcaaaaccatcaacgacagccacggccacagtgcaggggatgcagcgctgcgccaggcggcggagaccatcctcggcacctgccgcagcagcgatctggtcttccgctatggcggcgaagagttcctggtcgtcgcggtcgaggccggcgaagcggccgcgcgtgcgctggccgaacggctgcgcgaagccatcggcaagaccgaagtcgtgctctcgggcgatacccgcatccggctcggcgcttcggtcggtgtcgcggtgttcgacggccatcccgattacaaccatctggtcgaagccgccgacagcgccatgtatcaggccaagcgcgcgggtcgcaaccgcgtggtggtcgccggcggccgatagcctcttctgtccgtttccaaccctcacccccgcccggccccacagggccatatgtcccctcccgaggagcgagagatgtatccgaataccagcctcttcatcgacggtacctgggctccgggctcgacgggcaaggacgaggccgtcctgaacccggccaccgccgaggagatcggccgcgtcgcccatgcgtcgaccggcgatctggaccgcgcactcgaggctgccgcccgggcgttcaagacctggcgcaaggtctcgccctatgaccggtccaaggtgatgcgcaaggcggccgatctgctgcgcgagcgggccgacaccatcgcccgcatcatgaccatggaacagggcaagccgctggccgaagccaaggtcgagacgctggccgccgccgacctcatcgactggttcgccgaggaaggccgccgcacctatggccgggtgatcccgtcccgcgccgtgggtcatctccagaccgtgacgcgcgagccggtgggcgtcgtcgccgccttcacgccctggaacttcccgatcaaccaggtggtccgcaaggtctcggccgcgatcgcgaccggctgcaccatcatcgtgaagggcccggaagagaccccggcaagctgcgccgagctgatccgcgcctatgccgatgccggcgtgccggccggcgtgatcaacctggtctacggcattccggccgaggtctcgtcctatctgatcccgcatccggtgatcgccaagatctcgttcaccggctcgacggcggtcggcaagcatctggcggcgatggccggccagcacatgaagcgcgcgaccatggaactcggcggccatgcgccggcgatcgtgttcggcgatgtcgacgtctcgaaggcggccaaggcgctggcggcgcagaagttccgcaatgccggccaggtctgcgtctcgccgacgcgcttcctggtggaagagagcgtcgccgaccgcttcgtcggtgaattcaccgaggcggtggcctcgatcaaggtcggtgacggcctcgatcccgagacccgcatggggccgctggccaattcgcgccgcgtggatgcgatggaagccctggtcgccgatgccgtcgccaatggcgccaccatccgcaccggcggcgagcgcatcggcaacaagggctatttcttccagccgacggtgatgaccggcgtgccgctcgcggcccggatcatgaacgaagagcccttcggcccggtggtgccggtttcgaccttcagcggctatgacgcgctgatcgccgaagccaaccgcctgccctatggcctggcggcctatgcctacacctcgtcgtcgaagaccgcggcagcactttcggccgatatcgaaagcggcatgatctcgatcaaccagggcatgctggccctgcccgaggtgcccttcggcggcatcaaggattccggctacggctcggaaggcggcatcgaggcgatggagccctatctgatcaccaagttcaccgcccataacacgaccttctgacggtccgcgccgtcgaagcggaagaggccgggacggtaacgtcccggcctctttttcgtggagcggtcggtgctcagtccgtaccggtcgcctgttcccagaggcgggcatccgggtcccgggccagcgccaccaccaccgcattggtggtgtgttcgatatggcggcggatcacctcggccgcgcggtcgacattgcggtcgagggccgcatccagcagggcgcgatgttccaggtggatgtcgcgggtcatcacggtcttggcgcgcgacaggcggcgatagcgttcatgatggcggaacatcatcgcccgcatgcgcagaagccaggtcgaggcgcaggccgagaccagggcctcgtggaaatcgtggttcagccgttcccattccgacatctgctcgacgccctggcggtcggccagctccagccgttccagccggtgataggtggtgatgacccgctcttcccaggcgacatcgccggccgggatcgactgggccagggcatcggcctcgaagatcttgcgcagatggccgatctcgcgggcatcggtcgccgacatcggcgccaccacgaagccgcgctggccctgcatctgcaccagatattcccccgacagccgggccagcgcctcgcgcagcggccccgccccgatctgatagcggtcgcgcagcatctcgatcttcagcttcagatcgggcggcagcgccccggtgacgatgtcctcgcgcatcaggcggtaggcgcgttcggcctgggtcttgtcttcaatatccggtcgggcggggctatccgggcggacgggcgatcgcttgtccatgcggtacgggtttcccggcgagattgaaatcagaggcaggctagttcggctgcccgaaaatatcaatttccaaattgacacgctcaaaatatcgatattttatgcccgcagggaggaatatcgatgacaaaaatcctcgaagaagccggcgcgtcgcagtccccgctgcacaccggcacccgcggcgtccctggtccggtcgcctgcctgcaaacactcagcaaccgcatcgccggggtcgaagcctgggcggcggggctgacggtgttcggcatcttctgtctgctgctcggcaacgtcgtctcgcgcagcctgggcaatccgctgatctggaccgacgaactggccgtgttcctgatggcctgggcggccttcatcggcgcctcgctcggcctcgcgcggcgtcagcacatcgcgatcaccctgctgccggatgcgctcaggcccgccgcgcggcgccagctcgcgatcctggtggatgtggcgctgctggtcttcctggccgtgctctcggtgcagatctggcgctggttcgatcccgtcggcgtacttcaggccccgtcgatcgaggatttcacctcatcgaccttcaacttcatctatcaggagccgacggtgacgctgggcatgcacaaggtctggttctggctggtgatgccgatcttctgcgtcaccgccaccatccatgtgctggcctcgctcgctggccgcctgaccggcggggaggagatggcggcatgatcgcgggcgtctctttcctcgccatgctggcggtcggcatgccgatcgccttcgcgctcgccgccctgggcctgatctacatcttcgccaccggcaacctgatcctgctccagtcctatggccagcagatgttcggtggccttgagaattacggcctgctggccctgccgctgttcatcctgctgggcgagttcatgaatgccggcggcatcggccggcggctgatggcgctggcgctggccatgctgggctcgatccgcggcgggctcgcctatgtcaacctggtcgccaacatgatgatggcggcgattttgggctcgacggtggcccagatcaccatcatgtcgcggctggcggtgcccgagatggaaaaggccggctatccgcgtgacgtatcggtggcgatcaccgccgccggcggcctgctggcgccgatcatcccgccctcgatgctgttcatcatcttcggcgtgatcgcgcagatcccgatcggcgacctctttatctcgggcatcgtgccgggcctgctgatcttcctcgccttcatcggcgtgatcatgtggctgggccgccgccacggctttcccaagaccgaggcgatgccgatccgcgcccgcttccgtgccgtgctcgatgccctgccggcggccgccattccggtgatcatcgtcggctcgatcctgggcggccttgccacccccaccgaatcggccgcgatcgccagcctcgccgcggtgctgatcggcctgttcgtctatcgcgagatgacgccggccgacatccttcccgccttcctgaatgccgcgcgcggctcggcgaccgtgctgttcctgatcgccgccgcccaggtgttcagctgggtcatcaccttcgagaacctgcccgccctcgtcgccgagaccatgcaggcgatgaccgcctcgccgatcgtcttcctgctgatgctgaacgtgctgctgctggtgctgggcatgatcagcgacccgatccccgcgatcatcctgatcgtcccggtcttcctgccggtcgcgaccggcgtctacggcatcgatcccttccatttcggcgtcgtgctctgcctgaacctgacgctgggtctgctgacaccaccggtcggcaccgggctgttcgtcgcctcgctgatgggcaaggtcaaggccgagcgtctggcggtgctgctgatgcccttcttcttcgcggtgctgtcggtgctgctgctgctggtcgtcttccccgttctttccaccggccttaaggatctgctctgatggcgcgcatctggatcctgggcggcggtctgatcggctgcggctgggccgccgccttcgccggcgccagccatgaggtgacggtgatcgaccccgatccggccgtcgcagaccgcatcgccaccgtccgggcgcaggcacttccggtgctgcagggcctcggcaccctcagccccgatgcgaccacgccccgccatgtcgcgaccgcggccgaggccggcccgccgccggtgctggtgcaggagaacctgcctgagcggctcgatctgaagcgtcgggcgctggcggcactggaaccgcatctcgcggacgacaccatcatcgcctcgtcctcgtcgggcctgtcgcccgacgacatggccgaaggactggcccggccggagcgcctgctgatcgcccatccctgcaacccgccctatctgatgccggtggtggagctgtcgggcggcacccggaccgcgcccgaggtggtggcgcgggcgtccgacctcttccggacgatgggcaagacggtgctgacgctcacccggccggtgcccggccatctggtcaaccgcctgcaggccgccctctggcgcgaggcggtgcatctggcgagcgagggcatcgccagcctcgccgatatcgaacaggcggtgatccagggtctggcgccgcgctggtgcatcgtcggcccctccaccgtcttccatctggcgggtgccgagggcggcatcgggcgtttcgtcgatgcgctcggccccgaattcgaacgctggtgggcgacgctgggcgatccgcgcctggatgccgccacccgcgcccgcctcgtctccggcatggccgaggcggatccgcggccggtggccgagatcgccgccagccgcgatgccggcctgaccgaactcatggtcttcctctccaagaaggaagccaccccccataacgataccccgagaggaaaccagggatgaaagcagcacgcatcctgaccgcagccgccgcattgatggtcggcctgatcggcgccgaggcccaggccgaacagtatcggctgggcctgatcaccccgccgccgcatcagtggtcgaagagcgcggtgacggtcgcagagcgcatcaaagaagccaccaacggtcgggtcgagatcctggtcttcccctcgggccagctcggcaacgaggcgcagatgctccagcagctgcagaccggcgcgctcgacttcgccttcctgacgctgggtgaattcgccaaccgcgatgccgattacggcgtcttcctcgccccctatatcgtcaaggacgccgcgggcgcgcggcagatcctgaagggcggcgtggcgcagaagctgctgggcggcgtgtccaaattcgccctcaagggctttggctggggcatggccggcatgcgccagatcgtgatgcgcggccccgtggcctcggtcgaggatctgtcgggcaagaaggtgcgcaccgtgcccttcgcccaggagctggatttctggacccggctgggcgcggcgcccacccccactgccgctgccggcgctctatgacgccttcgccaacggccaggtcgacggcatgcagatcgatttcgagggcacctggaactcgaagtattacgagcatgccggcacgatcgtggcgtccaaccacatgatgttcccgatgatcgccgtcggctcgggccgcaaatggcagaccgtgcccaaggaagatcaggcggtgatcgaaaagatcatggccgaggagctggacggcatcgtcggcgcctatgccgagatcgacgctacctatctcgacaagctgaagaccaccagcgtgccggtggtgaacgccgatcgcgccttcttcggtggcgccatcgacctctggtaccagtcctggcgcgagaagaccccgctgctgaaggaactggagaaggaagccgcgggtctctgatccgccccggccttctttcccactgccacggccgccgttcctcccctcgggggacggccggccaggaggacgatcgagatgaccgatatctaccgggatctgcgctatctgcgtgtgcccgtcgaggatctggacggtgccgaggccttcgccaccggcattttcggcctgcagccgggcgatcacgacgatgccaatcgccgcttccgctcggatgcgcgcaattacgcgatctgctacacggccgaggccggccccgccgcggtggcgctcaccgtcgcccatgcccgcgagctggacgaggccgaggcgcggcttgaaaccgcctgtcccggcctgccccggcagcgcctggatgcggcggcctgcgccgcgcgacagatcaaggccgggttgtcggtgatcgcccccaatggcgtggtcgtcgagatcgtctggcggccgctcacctcgggctggcgctatcacggatcgcgcgatgccggcatcaccggcctgcaatcggtccagatcgcctgcaccgacccggccgcgaacgaggatttctggacccgcggcatcggcgccgaggtctcggactgggcaggcgatgccgtgttcctgcgcatcgacgacgcccatcaccgcatcgccctctacccctcggatcgcgacggcctgctgggcgcggtctgggaggtcgacggcatcaatgcggtgatgcagggctggtatctgttccaggcccgccaggtgccggtggtccacggccccggccgccagccgacctcgggcgcgatgttcgtcaccgcccgcggccccggcggcctgctgcattcctatgcccatggcatggagcggggcccggcggtgaccggccgtgggccccgccagttcgccgacgccgccctgtcgcattgcgcctgggggtcaccctgcacggcccccgaatttctggggagggatgagaggtgatcggtctcaaggacgtcgtctattgccgtctcggcacccgcgatctggccggtgccgaatggttcgcggtcaacatcctggggcttgaggtggccgagcgccgcaagggcgcgatctacttcaagtccgacgcccgcgcccacacgctctgctatgtcgaaggcggccgcgagcaggaggcgacggccttcgagatcgcgacctccgccgatctccagaacgcgggtgcggtgctggaaaatctcggccatgccgtccattacggcacgcctgccgaatgcgatgcccgccatgtccgcgaattcatccgcttcgacgacccgagcggcaaccacatcgaattcgtggtgcggcccgagactacggcacagcgctatcacggcagccgcgatgccggcatcaccggcttttcccatgtcgggctctgctccaccgacccggcgcgcgacgagctgttctggaccgatgtctgcaaggcgcgggtgtcggaccggatcggcgatgcgccgctgatgcgcttcggcaccatccatcactcggtggcgctgttccccttccaccagccaggcatccagcacgtcaaccatcaggtggcgagcaccgacgacatccagcgctcgctggcgcatctgcgccgcaaccaggtgacggtgaccttcggccccggccggcaccccacctcgtcggcacagttcctgtatttcgccggccctgacggcatgaccttcgaatactcgaccggggtgtgcgagatccacgacgagccgctgtggcgggaccgccagttccatttcgcgcccaagggcttctgtcagtggggttcggcacccaacatcgccgccttcaaggactgagatcatgaccgatcgtcttgctgcaaccgtccgggtcgctgcccgcgcactcggacgggccgggctggtgcatgcctatggccactgctcggcgcggatcgatgccgacactttcctggtctgcccctcgcggccgatggggctggtacgtccggacgaggcctgcaccgtggtgccggtggaaggtcccctgcccgccggcgtgctgggcgaggtgcggctgcaccagcggatctatgcgaagcgccccgaggcgcagggcgtggtgcgcttcatgtcgcccaatatgatggcgctggccgccctcggccgggtgccgcgcatgcgccatggcttcagcacctatttcgcccccggcgtcgggctctgggacgacatccagctggtccgcgacgacgagaaggcggcgggcgtgatcgcggcgatgggcgagagcgccggcgtgctgatgcgcggcaacggcgcggtcgtggccggcgccagcctggaagaggcggtgggccttgcctggtatctggaagacgtctgccggatcgagcttgccgccctctccaccggcctcggcgacaccgccccggtgatcggccccgaggccgccgccgcccgcgccacccgtgccggcctgatcttcgaacgcatgtgggactacctgaccgacggcgatcccgagcgcgacatcgccacgccgccggccgaccgaaaggaatgaccgacttgacccgtttcctgaacttcatcgacggcgaattcgtcgcgggcagcggcgaggccttcgccaatcattttccgaccacgggtgaagtcatcggcgaggtctccgcggccggccgggcggacgtggacgccgcagtcggcgccgcgaaagcggcgctgaagggcccctggggccggatgtcgatccccgaacgggtcgccctgctgcgcaagctggccgacggcatcaacgcccgcttcgacgagttcctggcggccgagatccgcgacaccggcaaaccgcgctcgatcgcctcgcatatcgacatcccgcgcggggccgccaatttcaacgtcttcgccgaccagatcctgaccgcctcgaccgaaaccttcgagatggcaacgcccgacgggggcggcgcgctcaattatgcgctccgcctgccgcgcggggtgatcgcggtggtctgcccctggaacctgccgctgctgctgatgacctggaaggtcgccccggcgctggcctgcggcaacaccgtggtcgtgaagccctcggaagagacccccgccaccgccaccctgctgggcgaggtgatgaatgcggtcggcatcccgcgcggcgtctacaacgtcgtccacggcatggggccgggggcggccggcgagttcctgaccagccatccggacgtcaacggcatcaccttcaccggcgagacccgcacgggtgaggcgatcatgcgcgcggcggccggcggcatccgcccggtctcgctggaactcggcggcaagaatgccggcatcgtgttcgacgacgcagatctggaggcgacgctggaaggcctggggcgcgcctgcttcgccaataccggtcaggtgtgcctgggcaccgagcggctctatgtccagcgcggcatcttcgaccgcttcgtcgaagggctggcggccaaggcgcgcagctaccgcttcggcgaccccttcgaccccgccaccacaatgggcccggtgatcagcgccgagcatcgcgccaaggtgctgtcctattacgacaaggcgcgtgcggccggcgccacgctgatcgccggtggcggcacaccggatgtcgcgggctatgccggcggctactgggtggagccgacggtctggaccggcctgcccgaggatgcggccgtggtccgcgacgaaatcttcggcccctgcacccatgtgacgcccttcgacaccgaggaagaggcgctggcgctggccaacgacaccccctatggcctcgccacctcgatctggaccaccaatctcggccgcgcccatcgcaccgccaaggcgatcgaggtcggcatcgcctgggtgaactgctggttcctgcgcgatctgcgcacgcccttcggcggctccaaggcatcgggcatcggccgcgagggcggcatccattcgatggagttctataccgaactccgcaacgtctgcatcaagctctgagagagggatcgggtttaccatgctgaccgaagaacagcgcgcacgctgcgtcgacagcctgcttgaaagccaccgcaccaaggtgcagggccagcgcccctcggagatgttccccgagatcgagatcgccgacagctatgcgatttcctcggcggtggccgccgccaaggtgaaggccggggcgaagatcatcggccacaagatcggcctcacctccaaggccatgcaggcggcatcgaagatcgacgagccggattacggctacatgttcgacgatctggtgctcgccgacggcgccaaggtgcggttcgaggatttttgcgtgccccgcgtcgagccggagctgaccttcatcctgaaggagccgctgaagggcccgaatgtcggcctggtcgatgtgctgcgcgccaccgaatgggtcgtgccctcgatcgagatcatcgatgcccgggtgaccgagccgcggcggatcttcgacacggttgccgataacggtgctgccgccggcctggtgctgggcggccggccggtgcggccgaccgatgtcgacctgcgctgggtgggggccatcttctaccgcaattccgagatcgaggagacggggctcgccgccggcgtgctcggccatccggcgatggcggtggcctggctcgccaacaagctcgcccccttcgacgtgacgctggaacccggccacatgctgctctcgggcagcttcacccggccggtctgggcgaagaagggcgacacgctgcatgccgatttcggcccgctcggcgccgtcgccgtgcagttcgtctgaggtgcggcgatgaaggccccgcgcaacgacttcaagcgccggcttaccgccggtgaggttctgaacggcttctggctgtcgctggcaagccccgtcgcctcggaagccctgtcgctggccggcttcgactggctgctcttcgatggcgagcattcgccggtggatgtggccggcgtgcagccgctgctgcaggcggccgccaccggcaccgcctcggcggtggtgcgcccggcctggaacgacaaggtgctgatcaagcgcctgctcgacatcggcgcccagaccctgctggtgcccttcgtccagtcggcggaagaagccgcggccgccgtgctggcctcgcgctacccgccccatggcgtgcgcggcgtcgccggtgccacccgcgccagccgctacggccagaccgaagactattttgcagtcgccaaccaggagatctgcgtcctggtccaggtggaaaccggcgaggcgctggaccggctggaagagatcgcggcggtcgacggggtcgacggcgtgttcatcggcccctcggacctcgccgcctcgatgggtcatctgggcaggcccggccatcccgaggtgcaggcggcgctgaaagacgccgccgcccgcatcgccgccaccggcaaggccccgggcatcctggcgaccaacgccgccgatgcccggcgctatgtcgactggggctatcgcttcgtggccgccggggtggatgtgggcgtgctgatggccggcgcgaaagccatgctggccgaggtccgcggcggctgacatctgacgcgatcggaacgatgcacgggggaggacggcatggccgtcctcccccgtttcccgttctcccccggtcacgttcacccgcccgccgcccactggtcgagcagccggatccaaagcgccttggcgcggagctgataggcgatcatgccctcggtcagccggcgccgcgtctcgcccgggcgcaattcgtcgggcagcagcggatcgcgcaccagattgcggatcaccgtgcggccgatggcgagcgagtccgccgccaccggctcgggcgccgcctcgcccgcctcgaccgcatcctgcgccgcattgccgcgcgccagcagccggtcgaggtcggcctccacccggtccatggcggcggcatcccagagcgcgcgcgcacccgcctcgtcttcaggcgccagatcatccaggcgaaacacggtcgacaaaggggccagacccagctgcgtcagatcatcccgcagcgccgccgtgccgccggccagattgtcgggccggatccacaccccctgggtcagctgtcggaagccgcgcagccgcagcgcgcggtcgtggcggcgcagctgcggccggtccgtccggtcgatcgccgcatcggcgacaccgatccaggcgccggaccaggccaccagacgcctttcccgccgccgccagccatccacctcgcgcaccagcgccccggccgcggccagcgcatgaacgccccgcgccggagaggcgatcaccccgtccgccttcagccggctgagcgccacccgcaccgtctgatcggtatagccgaagagattgccggcccgaaccagcgccttcagcggcagttcatgcgcgtcatgtgtcgtcaaaagatccagaaccatctcccgtgcgttgggcggggttggattcgtgaccgtttcagtggaaactgaagcgtcggcttgcgatgtttcgtcgatcgtcattaaataccataaactgaagcaaacggcttgacccgacggagacacccgatgagcacagatgacaccactgcagaccggccggctgtcagagtcgagaccgaagccggcattgcaaccatcatcctggatcgccccgcgcggcgcaatgcggtggaccggccgacggccgaggcgctgcgtgcggcctttgccgcggcggatgctgatcccgaggtgcgggtgatcgtgctctgggggaatggcggcaccttctgcgccggggccgatctgcgcgccctgggcgacccggatctgcgcaacgaggtggagccgaccggcaccggtcccgggccgatggggcccagccggatggtgatcgacaagccggtcatcgccgcggttgccggccatgccgtggccggcggtctggaactggctctgatgtgcgacctgcgggtcgtggaagaagatgcggtcttcggcgtgttctgccgccgctggggtgtgccgctgatcgatggcggcacggtgcgcctgccgcggatcgtcggccatggccgggcgatggacatgatcctgaccggccgcccggtcgatgcgatcgaggcgctgaccatgggccttgccaaccgggtggtgccgaagggcgaggcgcggacggcagccgaagcgctcgcccgccagatcgccgccttcccgcaggcctgcatgcgcgccgaccggcgatcggcgatcggccagtgggatctgccgatggccgaggccctggttcgtgagggcgccggcggctacccgatcgtgttcgaggaagccatcgccggcgccggccgtttcgccgccggcgccgggcgccatggcagtttcgaagactgaccgaagaaccccggcacagaccggggcaggtgaccatgcaaccatgccggccgcgcccaagcccgcggccccgtgacagggagaccagacgtccgatgtccgccaccgcctgtggacctctctaccgcgacctgatcgaccagggtgcgcgctggcacggcccgcgcacagcgatcgaattcgaaggccaaagcctgaccttcaccgaggtcgaccagctctccgcccggctcgccaacgccttccatgccgccggcctcggccaccgcacccgcgtggcgctgctgctcgacaacggactgatgagcgtgccggtcgatttcgcctgcgtgcgcgccggcatcgaccgcgtgccgctgaattccaggctgtcgctgcgcgaacacgcccatatgctgcgcgaaacccgggtcagtgccctggtctacgggccggaactcgcaggccgggcggcagagcttgcggccgaactgcccgatctgaccctgctcggcctgggcacaaccgagggcggcggcagcgatgtcgtggcggccgcggccgaccagcccaccaccccgcccgcgatccgggttgaacccgacgacgtggtgctgacgctgttcacctcgggcacgaccggcacgctcaaggccgcgcagcacacccaggcctcctatgccgcgatctgccgcaacgtgctgctgaacctgctgccggccggccccgacgacgccatgctccatgccgcctcgctgatccatgcgagtggcgtgttcgttctgcccttctggctgcgcggcggccgcacggtgatcatgcgcggcttcgagcccgatgcctacctggcccggatcgtcgaagacggcatcaccgcgatcaacatggtgccgaccatgctgggcatgctgctcgaccggccaggggcggccgccgtggcggacagccggctgaaaacgatcatctacggcgcctcgcccatgccgcggccggtgatcgaacgggcgatggcgatgtgggggcagcatcgtttctggcagtattacggccagaccgaatgcccgctgaccatttcggtgctccgcccggaagaccatgttgcggacctgctgggtgccgccggccggccggcgctggatgtcgaactccgcatcgtcgatgccgccggccaggacgtgccggcgggcgagccgggcgagatcgcggtccgtgcgccccagcggatgaagggctatctggacgcgcccgcactcaatgccgaaaccctgctgcccgatggctggatgcgcacccgcgacatcggccggatctgcgaccgcggctatctgcacctgctggaccgcacctcggacatgatcgtcaccggcggctacaacgtctatccgcgcgaggtcgaagacgtgctggcggcccatccggccgtcgccgaatgcgcagtgatcggccttgccgatccgcaatgggtggaagccgtgaccgtggtggtggcgctccgccccgaccaccgcgcccgcgcggctgccgaccccgaaggcttcaccgaggaattgcgcgccttcgcaggcgaacgcctcgccggctataagaagccgcgccgggtgatcgtggtggatgcgatccccaaaaccgcggtcggcaagctcaaccgcaaggccctgcgcgacacgcatcgggcgggctgacacgcccgacccgtcatcggacgtctcaggccggccgcgatccgtcgcagccggcctgatttcgttcgggcggacgattgtctcccgacctcacttccgccccggcctcacttccgccctggcctcacttccgaccggtctcgatccccagccgttcgatcatccggccggtgtcgcgcagatgggcggtcagcagctccaccgcggtcggggcgtcgcgggcgatggcggcgtccatgatcgccttgtgctcggcctcgatgtcgcggccggcggtgccctcgccggccgatgcaccctcatcatccggggcggcgcccgcgcgcatcagggccgggcggcggtagcgctcggtctggacatagagcatttccgacagctcccgcgtccagcgcgagggacaggcggcgatcagggcgcggtggaaggcctggtggcggcgctcgatttcctcgatcgccggctcgctcggccagtcgccggcggcgcgcaggcgtttgctgcaatggctgagggcatggaacgcctggacgatgccgatttcccagtcgtctccaccccgggcgatcgcggcggtgagcgcctcgcgctcgatcatgatgcgggtctcgatcgtgtcccacatctcgtcgaccgacatttcggcgacgcggaagccgcggagcgcataggccgtcaccagccgctcgctctgcagccgcgccagcgcctcgcgcagcggcgagaagctgagcccgtaggtctccttcagatactcgaaccgcataggctggcccggcgccaggcggcccgcgacgatgtcgcggcggatggcgcgataggcctgttcggccagcgtctgggcgggctcggcatcggcttcggcacggatggcggcggtgtcggccatggcggctccgggggtggcgggtctgggggtggcccatctgggtgggacatcggcccatgggatatgaacccggcgcgcgatcttgtccagaccgctttcgcaggacgcctccatcctcgccaatctgcacgatcgacgcaagtcttctggattttcgacaatccgtttgactttctacagaccgggtcctagcgtttgaacaggacgcaggccggggcatgaggtttccttgaagagacctgcccggggccggcgtgacgccggcgcgggagagacgccggaatcgacagacagggaaattccggtccgcagggagaaccgatcgatgcgggaagacattcccggccgggcgaatgtcgccgacacgcccgaactcgccgcctattacgaagagctggccgcccgcgagatgggcgcgctgtggacggtcgccaacgatatcgagccctggttcccgaagccgaaatcggtgccggtgatctggcgctggcaggatgtccgccccttcgtcgaccgtgcccccggcctggtgcggccggaagatgccggccgacgggtggtgatgctggtcaatccgggccggcgtgacatctcggccgcggtcggcctgctctataccggcgtgcaggtgatggatccgggtgaatgcgccagcgcccaccgccatatggcgagtgcgctgcgtttcatcatggaaggctccggcgcctataccatcgtcgagggcgagcggatgaccctcggcgcccgcgatttcgtgctcacccccaacggcacctggcatgagcatggcgtggccgagggtggcacccgcagcatctggcaggacgggctcgacatcccgctgatgaatgcgctcgacgccaatttctacgcggtccatcccgatctgcatcagggtgagacgaagccggtcgacagctccgcaacgctctggtcgggcggaatcatccagccgaccgagctgcgcaagaactggcagaaaccctggtcgccggtgctgaaatacgccttcgagccggccttcgaggcgctgacccgcgccgcgaaggttcatgaaggctcccccttcgacggggtgatcatggaatatgtgaacccgctgaccggcgggccggtgatgccgaccatcggctccagcctgcagctgctccgccccggccagcatagccgtgcccaccgccataccggatcgatcgtctaccaggtggccaggggcagcggcttctcgatcatcgacggcaagcgctatgactggtctgagaaagacatcttcgtggtgccctcctggtcgctgcacgagcacgccaatgcatcggagagcgaggacgcctgcctgttctcgttcaacgacctgccggtgatgcgcgcgctcggcatctatcacgaagaggcctataccggcacgcctgacggccgccaggcgatcatcgccggctgaagccctcacgacatcctcttcccccaccggtcgcccgcccccgcgcggccggtcgcgggagggcgtgtgcccgctctcccgcccctcccttccgtcacatcccccaatcgacgtcttttcgaggacctgatgaagctcgtcacctttgaccgggacggcgcggcgcggctcggtgccgtggccggcgacctgatcgtcgacctctgtgcgctggcaaccgccgcaggcgagacctgccctgcaaccatgctcgccctgatcgaagccggccccgcggcgctggacaatgtgaagcggctgatggccgcccatgacggcgcctggcccgccggcaccacggccaggctggcggatacccgcctgctcgcccccattcagcgcctgcccaagggcgtgatcggcgtcggcctcaactactccgagcatgtcgaggagagcagccggacgatggacaccgatcgcgacatgccctcgcatccggtgatcttcttcaagccgccgaccgccgtgatcgggcctgaggacagcatcgtccacaaccaggcccagacctcgcagctcgactgggaaagcgagcttggcgtggtgatcggccgccgctgccgcgacgtggcgccgggcgacgcgctcgaccaggtcttcggctatacctgcgtcaacgacatctcggcgcgcgacctgcgccatggcggccagtggtgcttcgccaagggccaggacaccttcgcgcccatgggcccctggatcgtgaccgccgacgagatcgaggatccgcatgccctgcgcatcggcctgcgcgtcaacggcgtcaccaagcaggacggcaacacccgccagatgatcttccgggtgccggcgctgatcgcgcatctctcgtcgggcatcacgctggagcccggcgacgtgatcgccaccggctcaccggccggcgtcggcatttcctatgtgccgccgcaattcctgaagccgggtgacgtggtcgaagtcgacatcgagaagatcggcgtgctcaaaaacacggtcgtcgccggctgagtcttttatttagtccctcgccgggcgggcactccgtgcccttggccgccgcctcaatggcggctggggggtgcaggcccatcgccttcctcacctaattcccctccccgcacccggtgcagggccggccgcgcgaacgagccggcccgcgccatccgtctcaagccatgacaggaggccagacatcatgcggaccaggatcaccgccttcaccctcggcctgacggccgcgaccgcgctttcgggcgtgctgttcgccgcgccggccgatgccgccgacccgctccggatcggcttcatcaccacgctctccacccccgccggctatatcggcgaggatgagcgcgacggcttcaaactcgccatcacccaggaagacggcaaactcggcggcgtgccagtggagctggtggtcgaggacgatgcgctgaagcccgccaatgccaagcagatcgccgagcgcatgaccggggacggcatccggctgttcaccggcgtcaacttctcgaacgtgttgtcggcggtcgcacccaccgtgctcaagaccggcgccttctatgtcagcctcaaccccggcccctcggtcttcgcgggcggcggctgcaatgcgaactatttcgtcgcctcgtatcagaacgacaatttccacgaggccggcggccttgccgccaatgaactcggctacaagaaggtcgtgatcctggcaccgaactaccaggccggccgcgacgcgctggaaggcttcaagcgcaccttcaagggccaggtcgtctccgagatctacaccaagctggaccagaccgatttctcggtggagctggcgcggatccgctcggcggcaccggatgcgatctaccagttccacccgggcggtgccggcatcaacttcgccaagcagtatgccaattcgggcctcgccaaagagatcccgatggtgctgccggtgttctcgatggatgcccggatgatggcagccaccggcgatgcggccgaaggctattacatcgccagcaactggagcgccgggctcgacaacgccgccaacaaggacttcgtcgccgccttcgagaagacctatggccgcaagccgaccatctatgccgcccaggcctatgacaccgcgaagctgatcgcctccgggctcgacaaggtcgatggcgatatcgagaagcaggacgcgttccgcgcagcactcaaggccgccgacttcacctcggtgcgcggcagcttcgccttcgcccagaaccagcacccgatcctggactggtatctgatgcgggtggagcgcggcgccgacggccagctggccgatacggtggtgcgcaaggtggcgaccgccatgcaggacgcctatgccgccgagtgcaagatgtgacgccgggcaagatgtgacgccggccaacatctgacgtccggcaccggacgaccgggcggcggtgccttgcgccgccgccgcacttcctctcgcatgcggaagggcccatgtccacgctgctgatcgagcagatcctgaatggtctgcaatacggcgcgatgctgttcctgctcgcttcgggtctcaccctgatcttcgggatcatgggggtgatcaacctcacccacggctcgttctacatggtcggcgccttctgcgccgcctatgccgccaccgccaccggatccttcgccgcggcggtgctggcggcactcgcgggcgccgggctttacgggctggtgatggagctggtcgtcatccgccggctttatgcccgcgaccatctggaccaggtgctcgccaccttcggcatgatcctgttcaccaacgagttggtgagcgtggtttttggccgcacgccgcccttcatggacatcccgtccttcctgaccggcaccgtcgcgctgctgcccggcctcgcctatccggtggtgcgcctcgccttcatcctggtcggcgccctggtcgccatcgggctctggctgctgatcacccgcacccggatcggcatgctgatccgcgccggcgccgatgaccgcgcgatggtcgatgcgctgggcgtcgacatccgccggctgttcagcctggtcttcgcgctgggcgcggtgctctgcggtcttgccggcgtgatgacggcacccctgctcgcggtcgagatcggcatgggcgagcgcatcctgatcaccaccttcgtggtcatcgtggtcggcggggtcggatccgtgcgcggtgcggccgtgggtgcgctgatcgtcggcatgatcgacagcctgggccgggcctatatcccgatcaccctctacgaattgctgccgcccgagatcgcgagcacgctcgcggccgggctggtctccgccagcatctatgtcgccatggcggcgatcctgcttgtgcggccgcgcggcctgctgcccgcccgaggataggaagacatccgatgtccgacagccttacccacagcgcggcggcagccaccacctcccgcccgggccccgggcggcggctggtggtccatggtctgggccttgccgtcttcgccgccatgccgcttgtcgccgccgcgatcggcgaccccttcgtcgtcagcctgttcacccgcttcctgatctatgccatcgccgcggtggcgctcgatctggtgatgggctatggcgcgctgatcagcttcggccatgccgccttcttcgggctgggcggctatgtggtcggcatcattgcccatcacgccgccgagaccggcacgatcttcggtctggcgaccagcaattcggcgcttgtggtctggccggtggcgatcgggctgtcggccctgctggccctgatcatcggcgccctgtcgctgcgcacccagggcgtgcagttcatcatgatcaccctcgccttcggccagatggtctatttcatgctggtctcgctggaggtctatggcggggatgacgggctgctgatcatggagcgcaacaccctgccggggatcgacctctccaacccgacggttttctactatctctgcctcgccatgctcgccggctggctactgctctgccggcggctggtggggtcgcgtttcggcatggtgctgcgcgggctgaagcagaatgagcgccgggcggtcaatctgggcttcgcgccgctgccgcaccgcctggccgctttcgtgatctcgggtgccggcaccggccttgccggcgtgctctgggccaattacgcgctctatgtcagccccgacatggccgcctggtccaaatcgggtgaattcatgtcgatcgtgatcctgggcggggtcggcacgctgttcgggccggtgatcggcgctgcggtgttcctgggcctggaacagctgctggcgatctggaccgaacactggatgctggtgatggggccggtgctggtggcggtggtgctgttcgcccgccgcggcctctatggcttcctggtcggggagagagcccatgactgacgccaccgcagccgaactgccccggctggtgatcgaagggctgcacaagcgtttcggcgccgttgccgccacggccggggtcgatctggaggtgcgcccgcgtgagctgcatgccctgatcggccccaacggcgccggtaagaccacgctgatttcccagatcgccggcgaaatcttccccgatcagggccggatcctgatcgacggccgcgacgtcacccgcatggccgcctatgcccgggccggccaggggctggcgcggtcgttccagatcacccagctcttcaccgatttcaccgccctcgacaatgtcgccatggcgatccaggcccggcagggcggcaactggcgctgtttcggatcggccaggcaggaccggagcctgcgcgagccggcgatggcccacctgaccgcggtcggcctgggtcaccgcgccgatgaggtggtggcggatctcgcccatggcgaatgccggcagctggaactggcggtggcgctggccgccgaggcctcgctgctgctgctcgacgagccgatggccgggctcggccccgaggagagccggcagatgacccggatcctgcaggggctgaagggccgctatgccatcctgctggtcgagcacgacatggatgcggtcttcgcgctggccgaccgggtgacggtgctggtctatggccgcaccctgttcaccggcacgcccgacgaggtccgcgcccatcccgaggtgcgggccgcctatctgggagacggtgtctgatgctgaaggtcgatggtctggaagccggctatggccgctcgcaggtgctgttcggcatgacgctggcggccgaagagggcgaggtcgtctcgctggtcggccgcaacggcatgggcaagaccaccacggtcaacacgctgatgggcctgctgccggtgcgccgtggccggatcggcttcgacggcgccgacatcgccggccgtgcgcccaaccgcatcgcccgtgcgggcatcggcctggtgccggaaggaaggcgggtcttcgcctcgctgtcggtggaagaaaacctggtcgccaccgcccgccgcggcgccggcgcccgctggggccttgccgatgtcttcggcctgttcccgcgcctgcaggaacgccgccggcaatcggcgcgcacgctgtcgggcggcgaacagcagatgctggcgatcggtcgggcgctgctcaccaacccccgcctgctgatcctggacgaggcgaccgaggggctggcgccgatcatccgccaggaaatctgggcctgtctcggccggctgaaggccgagggccagaccattctggtgatcgacaagaacctgaaggagatggcccgcctggtcgaccgccatcacctgatcgagaaaggccgcgtggtctgggcaggctcccccgaggcgctcgcccgggaacccgatctcgcccatcgccatctcggcctctgacggagccccggcatgtcctctccccttcccttcacggcgggcgtcgcccagatcggcgccgatcccttcgatcccatggcctcggccgcgaaggtcgccgccaccatccgccgcgccgcaggtagcggcgtcgccctgctggtcttccccgaagcctgcatcggcggctaccccaagggtgccagcttctcgacgccggtcggcatgcgcctgcccgagggccgcgaggccttccgtcgctatcacgacgccgccatcgaccttcacggccccgaactggcgctggtggccgaggccgcagcggagacgggcatggtggtggtgctgggcgtgatcgagcgcgacggcggcacgctctattgcacggcgctcaccttcgacggcgcgcgcggcctggccggccggcaccgcaagctgatgccgaccgcggccgagcggctgatctggggcttcggcgacggctcgaccatggaggcggtgccaacccgcctcggtaccgttggcgcggtgatctgctgggagaattacatgccggcgctgcgcatgcacatgtacgcgcagggcgtgacgctctactgcgcgccgaccgcggatgatcgcgacagctggctctcttccatgcgtcatatcgcgcttgaaggccgctgtttcgtgctcaccgcctgccagttcattcgccgcggcgcctatcccgccgattacgactgcgcgctgggtgatgcccccgacaccgtgctgatgcgcggcggcagcgcgatcgtggggccgctcggccaggtgctggcggggccggatttcgacggcgagaccgtgctcaccgcccgcatcgacccggcggagatcctgcgcggcaaatatgatttcgatgccaccggccattacgcccgccccgacatcttccggctggaggtcgacacggcggcgaagcccgcagtgctgcgccgcgacggcgggctttgaggggcgggcaggatggagttcgatttcgcaacgctcgacaccgcccaccgctacaaggtgctggcctccaccgttgtgccgcggccgatcgcctgggtgaccagccgggcgcccgacggcaccgccaatgccgccccctacagcttcttcaacgtgatgggctcgaacccgccggtggtggcgctgggcatcctggcccgccccgacggcacgctgaaagacacggcggcgaacatcgtcgcagggggtgctttcatcgtccacctggtctcggaagatctggcaccggcgatgaacctgacctgcatcgacgcgccgcccggggtggacgagattgcgctcgcgggtctcgccaccacccccggcacgaagaccgggctgccgcggctggtcgatgccccggtcgccttcgaatgcgtcagccgtgcggcgatcgccacggggccgtcgcagatgctggtggtcggcgaggtgctgaccgcacatgtccgcgacgatgccgtgctcgatgccggccgctgccatttcgccaccgaacggctgggcctggtcgcccgcatgcacggcgccggctggtatgaccgcgtcggcaccgacatgttccggctcgaccggccggtctgggccgatcgcctgcttccggagaccggatcttgaccgctcttacccccaccgatcgcctctggcgcggcttcgaccgcgcgggcctggaccatcaatacgatgcccgcggcaccgtcgccgattacgaggcagaggcccgcgcctatgccgaagacagtgtggccgcgatgacgaccctcgaccggcgcgccgatctggtcttcgatccggcctcgggcgctgcactcgacctctacccggccgcggggccggggccgcatccggtcttcgtctgggtgcatggcggctattggcgggcgctttccaaacaggaaaatgccttcgttgctcccgcgctggtggcggccggggtcagcgtcgcggtgatcgactacacccttgccccggcggcgacgctggaagagatcacccgccagacccgggcggccgtcggctggatccatcacaacgccgccgcgcagggcctggatgccaaccggatcttcgtcggcggctcttcggccggcggacatctgaccggcatgctgctggccgcagacggctggcgggccgaggcggggctgccgcgtgatgtgatcaagggggccgtatcgctgagcgggctttacgacctggagccggtacggctcggccgggtcaacgactggctggggctggatgcaccccgcgcccggcggttgagcccgctgcatctgctgccgaccgatccggccgatggctgcccgctgatcgtttcttacggcggatcggagacggccgaattcaagcgccagaccgacgactatctggccgcctggaccggccacggccatccgggcaggttcgtggccatggaagactgcaaccatttcgacattgcccgccggctgggcacgcccggcacaccgctggcccaagccgccatccggctgatccacggaacctgacctgcggcatccgaccttccggagtggcatccgtggccagccgcgggcatgatgcgggtctggcacgaagatgcccgagaatcgcctgggagggaaaggtccgcatcatgatcgactggatggagaaggcgcgccggctgcaggatttctacgccggccggctgtcggccgacgaggccgaggccctgcgccgcgatctgggctggccggcgctgatgcccgccggtaccgccggggccggcatgcaggatgcctggacccgcggcatggccgccaacaaggcgatgttcgaggcgatgaccgcggcccccggcggcctgcccgatccggcccggatgggggccgccgccatggccatggcggcagcggcagccccggcgatggaggcctggcgccaggcggccgccggcacactgcgcggcttcggcgggttcgagaccaccgcgccgccggcgcccgcagccccggccgagacgccggccccggcgccagaggcggcacccgcagccaaagccgaaccgggtgccgagatcgagacctggcggcagcggctggacgctctgaaccaggagcttcagacggcggtggcgacgctgcgcagcctgcaggaagcgcccgatgccgatcccgcggcggtcgaggcaacgctgaagcgtctgcaggagctgaatgcggcagcaaccgaggccatgcagggctatcacgccgcgctcgccgccgaagccgccgggcagaagtgaccggatcctcggcggtcttcagaaaatatcctcgtcggcgtcgatcagcacgcttggccggcagaaccgcttcaccgcctcgatgtcggtgatgtcgatcgtgttgccgtcgaccccgacgccgtatttcttcagagccgcgaagctgcgcgacaggttctcgggcgtcatgcccaacagcgaggcgagtgtcttcttgtcgtagggcaggacgacgcggccggtgccgccctgggcgtcgttctggatcagcagccgcgccgccagccgctcggtgcccgagcgcagtttcagcgccttgtattccttgaccatggtccggaagcccaccgccagttcggtgacgatggcgcgggcgaaggcggcatccttttcgaaggccgcacggatgttctcggacgggatcatcagcaggcgcgacacctcggtggtccgcgccgacatcagatagaccgcgtcgcggatcaccgccgccaggatgaaggatctgaccggccggaccatggcgagcgtggtttcgcgtgcggcatggcggctgaacagctccacgcagccttcgaccacgatgtagagaaaatccgccggctcgccctcgaagatcagatcgacctggcgggggaagcgctgcagataggccgcgttcatcagctcggagaagttctccggttccatgctccggaacagcggcagcgcacgcacctccggcaggtcattcgctcgcatcacgatcctcttgatttttatcaagccctactttgacggacatataccgcggggctgtgcgcctgtaaatcacagaaccacgacaatcaatttccagtccttcataatcataagggcgatttatttcggaacatgaagccatgcttcttgatctggatcaacattcgatccggatacggggcctaacgtcggcgcatccccacatgcgggccacggatggcctgccaatccaggtggatgacttcgatgcaggcacccggcacccccgtcccgaaacaggcgggccggatactcggcatgagtactctggctttcaccacatcctttgccgtctggacgatcttctcgatcatcggaatccgcatccagcaggagctggggctgaccgatacccagttcggcctcctcgccggcactcccatcctgaccggatcgctggtgcggatcgtgctgggcgtctgggccgaccagtatggcgggcgcaccgtctttgcgctgaccatgctggcggcggcggcggcaaccgccctgctctcactggccgacagctacgagaccatgctgctggccgccctcggcgtgggcctcgccggcggcaccttcgccgtcggcgtcgcctatgtctccaaatggtatccgcgcggccggcagggcacggcgctcggcatcttcggtgccggcaatgtcggcgcggcggtgaccaaattcgtcgcccccttcgtgatggtcgccttcggctggaccacggtcgccctggtctgggcggcggcgctggcggtgatggcggtggtgttctggctgaccacggccgacgatcctgaaaccatcgcccgccgtgcccgcggcgagaagccgcgcagcgcctttctggaactggcgccgctgaagcggctgcaggtctggcggttcgcgctctactacttcttcgtcttcggcgccttcgtgtcgctggcgctgtggctgccgcattatctggtgggcgtctacgggctcgacatcaagaccgccggcatgctcgccgccttctattcggtgccggccagcgtcttccgggcctatggcggccatctgtccgaccgcaaaggcgcgcgcacgatcatgtactggaccttcggggtctcggtcatcgccaccttcatgctgtcctacccgccgaccgattacgtcatccacggtctcgccggcccgatcgccttttcgaccagcatggggctcgtgcccttcgtgatcctgatcttcgtgctgggcttcttcatgtcgctcggcaaggccgcagtctacaagcatatccccgtctactaccccgacaatgtcggcgcggtcggcgggctggtcgggctgatcggcgggctgggcggcttcatcctgccgctcaccttcggcgtgatgctcgacctgacgggcatctggaccagctgcttcatgctgctgttcgcgatcgtcgccgcagccttcatctggatgcatctctcggtccggcagatggaacgccaggcgctggcccccgaactcgacgccctgcccgagctgccggaaatgcgcgaaatccacggcccggcagagcgcgcggcgaccagccgggtgatcgaggactggcggcccgaggatccggatttttggaagaccaccggccggcgcgtcgcccggcgcaatctctggatctccatcccctgcctgctgctcgccttcgcggtctggatggtgtggagcatggtggtggccaagctgccggcgatcggcttcgcctattcgaccgaacagctgttctggctcgcagccctgcccggcctgtcgggcgccacgctccggatcttctatgccttcatggtgccggtcttcggcggccggctgtggaccacactctccaccgcatcgctgctgatcccggccttcggcatcggctatgccgtgcagaaccccgaaaccccctatctgatcttcctggtcctcgccctgctctgcggtttcggcggcggtaacttcgcctcctccatggccaatatcagcttcttcttcccgaagaacgagaagggcaatgccctcgccctcaatgccgggctcggcaatctgggcgtcagcgtgatgcagttcctggtgccgctggtcatcaccatgggcgtgttcggcgccatgggcggcgatgcccgcccgaccgcggcgggcgatatgctctggctgcagaatgccggcttcgtctgggtgcccttcatcctggtcgcgacggtggccgcctggttcggcatgaacgacatcgcctcggccagggcctcgttccgcgatcaggcggcgatcttcggccgctcgcacacctggatcatgtgctggctctataccggcaccttcggctcgttcatcggctatgccgccgccttcccgctgctcacccgcacccagttccccgaaatcgacgcgctgcagttcgtcttcctgggcccgctggtcggcgcattgtcgcgggccggcaccggctggatctcggaccgcttcggcggcggccgggtcaccctctggaccttcgtgctgatgatcgcaggcacggccggcgtgatctggttcctgggcatgaaggatcagccgggcgcgttctggggcttcttcgcgatgttcatggtgctgttcttcgcgaccggcatcggcaacgcctccaccttccagatgatccccgtgatcatgcgcacggtgatcgaccgcaccgccccggccaacctcgccccggcagagcggctgcgccaggccgagcgcgaatcggccgcgatcatcggcttcacctcggccatcgccgcctatggcgccttcttcatccccaaagcctatggcagctcgatcgccatgaccggcggtgccgaagccgcactgctgggcttcctcggcttctacgtcacctgcgtcgccgtcacctggttcttctacacccggaagaacgccccggtgcgctgctgagccgccgcacgcaaggaattcgtcccgatgagccatctcctcgaccgcctcaacttcctgtccgagaagaccgtcggccggttctcgaacggccacggcgtcaccaccaccgaaagccgcgcctgggaagacgcctatcgcaagcgctggcagcacgacaagatcgtgcgctccacccatggcgtgaactgcacgggttcgtgctcgtggaagatctacgtcaagggcggcatcgtcacctgggaaacccagcagaccgactatccccgcacccggcccgacctgcccaaccacgaaccccgcggctgttcgcgcggcgccagctacagctggtacatgtattcggccaaccgggtgaagcatccgctgatccgcggccggctgctcaaggcctggcgcgccgcccgcgccagcctgccgccggtggcggcctgggcctcgatcgtgaacgacccggcggcccgcgcctcttacacgaagctccgcggcctgggcggcttcgtgcgggccgactgggacgaggtgaacgagatcatcgccgccgccaatgcccacaccgtcaaggcccatggccctgaccgggtgatcggcttctcgccgatcccggcgatgtcgatggtctcctacgctgcgggctcgcgctatctgtcgctgctgggcggggtgtgcctgtcgttctacgactggtattgcgacctgccgccggcctcgccgatgacctggggcgagcagaccgacgtgccggaatcggccgactggtacaatgccggctttctgatgctctggggatcgaacgtgccccagacccgcacgcccgacgcccatttctataccgaggtccgctataagggcgccaaatcggtggtggtctcacccgactactccgaagcggccaaattcgccgatctctggctgcaccccaaacagggcaccgatgcggcgctggccatggcgctggggcatgtggtgctgcgcgaattccatctggaccgcaccacgccctatttcgaggactattgccggcgctacaccgacatgccgatgctggtgcggctggaacgtcgcggcgaccggctggttccgggccggctgctgcgcgcctcggatttcgaaggcggccttggcgagacggcgaataccgagtggaagacggtcgccctcgaccaccgctcgggcgagatcgtggtgccgcagggctccgccggcttccgctggggggatgccggccgctggaacctggagccgcgcgacggccggggccgcgagatcgaaccggtgatgaccctgctcgcaggcccgctgcatgacgaggtggtcgaggtcggcttcccctatttcggcaaccgcaagcacgaccatttcgaaggcaccgatcatgccgacgtgctggaccgccgggtgccggcgcggcgggtgcaactggccgacggcgaggcgctggtcgccaccgtcttcgacctgctggccgccaattacggcctggatcgcggcctgggcggcgccaatgtcgcccgcgactacgatctgaacgagccctatacccccgcctgggcggagcgcatcaccggcgtgccgcgcggccatatcatcacggtcgcacgcgaattcgcccgcaatgccgaaaagaccaatggccggtcgatggtcatcctgggcgccgggctgaaccactggtaccacatggacatgaactatcgggggatcatcaatctcctgatcatgtgcggctgcatcggccagtccggcggcggctggagccattatgtcggccaggaaaagctcaggccgcagaccggctggctgccgctcgccttcgggctggactggaaccggccgccgcggcagatgaacggcacctccttcttctatgcccataccgatcagtggcgctatgaaacgctcgacgtcgcctcgatcctgtcgccgacggcccccgagggcgactggtcgggcagcctgatcgactacaacatccgtgccgagcgcatgggctggctgccatcggccccccagctcgccaccaacccgctgacgctcgccgccgccgcaggcaaggccggccgggaggtcaaagactatatcgtcgacggcctggccgacggctcgctgaagatgtcggccgaagatccggatgcgcccgagaactggccgcgcaacctgttcgtctggcgctccaacctgctcggctcgtcgggcaagggccatgaatacttcctgaagcacctgctcggcacctcgcatggcgtgctcggcaaggatctgggcaaagagggccggcggcgctccaccgaggccgcgtggcacgaccgggcgccggaaggcaagctcgacctgctggtcacgctcgacttccgcatgtcgaccacctgcgtctattccgacatcgttctgcccaccgccacctggtacgagaagaacgacctcaacacttcggacatgcatcccttcatccacccgctgtcggccgcggccgatccggcctgggaagcgcggagcgactgggagatcttcaaggggctggcgcgcgccttctcgaaagtggcacccgaggtgctgggggtggagaccgatgtcgtgctgacgccgatcctgcacgacaccgccggcgaaatggcccagcccttcgacgtgcatgactggaagcgtgcgggtgctaagccggagcccggccgcaccgcgccgcagatcgcggtggtggagcgcgactatccggggctctacgaccgcttcacggccctcgggccgctgatggacacgctcggcaatggcggcaagggcatcggctggaagaccagccacgaggtcgaggcgctgggccggctgaacggcatccagcccgagggccgcagcacggccggacggccgcggatcgagaccgatatcgacgcgaccgaagtcatcctgatgctggcgcccgagaccaatggcgaggtggcggtgaaggcctgggaggcgctgtcgaaggccaccggccgcgaccatgcccatctggccctgcccaaggaagacgagaagatccgcttccgcgacatcgtcgcccagccgcgcaagatcatctcgtcgcccacctggtcgggcatcgagtcggaaagcgtctgctacaacgccggctataccaatgtccacgagctgatcccctggcgcacgctgaccggccgtcagcagctctatcaggatcatctctggatgcgggccttcggcgagggcttctgcctctaccggccgccgatcgacacccgctcgatcgatccggtgatccgcgagaaggacgacggcacgccgcaggtggtgctgaacttcatcaccccgcaccagaaatggggcatccactccacctattccgacaatctgctgatgctgacgctcaatcgcggcgggccggtggtctggatgtcggaggtggacgccgcccgggccggcatcaccgacaacgactgggtggaggtctacaacgccaacggcgcgctggtcgcgcgggcggtcgtgtcccagcgcatgaagcagggcacgctgtatatgtaccacgcccaggaaaagatcgtgaatacgccgggatcgaaggtcaccggccagcgcggcggcatccacaactcggtgacccgcgccatcaccaagccgacacacatgatcggcggctatgtgcagcagtcttacggcttcaattactacggcacggtcggctccaaccgcgacgaattcgttgtcgtccggcggttggacaagatcgactggctggaagggccgtatcgtgaggaggcggcggaatgaaagtcagagcacaggtcggcatggtcctcaatctggacaaatgcatcggctgccacacctgttcggtgacctgcaagaacgtgtggacgaaccgcgagggcgtggaatacgcctggttcaacaatgtcgagaccaagccgggcatcggctatcccaaggactgggagaaccagaagcgctggaacggcggctggacccgcacctccgacggccgcatacggccgcgcatgggcgccaaatggcgggtgctggccaagatcttcgccaatcccgacctgcccgagatcgacgactattacgagccgttcgatttcgactatggccatctccagactgcgggcgaggttcaggcctcgcccaccgcgcggccgcgatccctggtgacgggcgagcggatggagaagatcgtctgggggccgaactgggaagagatcctgggcggcgaattcgccaaacggtcggccgattacaacttcgcggatgtggagaaggagatctacggggccttcgagaacaccttcatgatgtatctgccccggctctgcgaacactgcctgaacccgacctgcgtcgccgcctgcccctcgggcgcgatctacaagcgcgacgaggacggcatcgtcctgatcgaccaggaaaaatgccgcggctggcggatgtgcgtctcgggctgcccctacaagaagatctattacaactggtcttcgggcaaatccgagaaatgcgtcttctgctatccgcgcatcgaggccggccagcccaccgtctgttccgaaacctgcgtcggccgtatccgctatctgggtgtgctgctctatgacgccgaccgtatcgaggccgccgcggcgacacccgacgagggtgatctctacgaggcccagctctcgatcttcctggacccgaacgaccccgaggtgatcgcccaggcccggcgcgacggcgtgcccgaggcctggctcgaagccgcccggcattcgccggtctggaagatggcgatggactggaagatcgccttcccgctccaccccgaataccggaccctgccgatggtctggtacgtgccgccgctgtcgccgatccagtccgccgccgatgccggccggatcggcatggacggcgagatgcccgatgtctcgtcgctgcgcatccccgtgcgctatctcgccaacctgctgaccgccggccgcgaacagccggtgatcacggcgctgaagcgcatgctggccatgcgcggctatatgcgcgccaagaccatcgacggcgtgcgcgacgaggccctggcccgctcggtcggactgaacggtgcgctgatcgaggacatgtaccggatcatggcgatcgcgaattacgaagaccgcttcgtgatcccgaccagccatcgcgagatcggcgaggacgcctatgacgtccgcggctcctgcggcttctcgttcggcaatggctgttcgggcggcaccagcggcgtcgacctgttcggagcgaagcgcacccgcacggtccacacccccaccgacgtcttccgcggggaggcctgacgccatgtcccggatcttcaagatcgcctcggtgctgctcacctatccgacgccggagcttcaggccgcagcgccggagcttcgcgccgccatcgctgcggagacctgccttccgtccgcattgcgcacggcgctcaacgaactggtcggcaccatcgccgatcgcgacatctatgcggcgcaggaagactatgtcctgctcttcgaccgcacccggtcgctgtcgctgaacctgttcgagcatgtccatggcgaaagccgcgatcgcggccaggcgatggtcgatctgctcggcatgtacgaggcggcgggtttcgtactcggcgcccgcgagctgccggatcacctgccggccttccttgaatatctctcgacccgcagcgcggccgaggccacggaactggcgggcggcatcggccatatcatcgaagccctgcaggaacggctgatcgcccgcaacagcccctatgccgcgatcttcgccgcgctgatcgcagccggcgccaccgccgaagaccgcgaggcggtcgcgatggtgatggacctgcccgatgacgacccgaccgatctggccgccctcgaccaggtctgggaggaagacgccgtgcgctttgccggtgccgcagccggcgagggcgactgcggccccgaccggctgcgccggcgcctgcgtgccgccgcccgccccgccgcagacccggcgccggccgcaacagaggaggtttcgtgatggccagctacatccacggcgccgtgttcggcgtctatccctatgtggcactcgcggtgctgatcctgggcagcgcgctgcgctatgaccgcgacccctatacctggcgatcgggatccagccagctgctccgccgccgccagctgatctggggctcggtgctgttccatctgggcgtgctggtgatcttcgcgggccatctggtcgggctgctgacccccatccaggtcttcgacacgctgggcatcagccatggcgccaagcagctgctggcgatcgtggcgggtggcgtcgccggcatcgcggccatcatcggtgccagcctgctgatccatcgccgcttcttcgacccgcgcatccggcgcacctccagcaccaccgatctgctgatcatcgtgctgctctggctgcaactggcgctcgggctcgccaccatcccggtctcgctcggccatctggacgggcatgagatggtgaagttcatgagctgggcacagggcatcttcaccttcgacaccgccgccgccggctacatcgccgatgtccacccgatcttcaaggcgcacctcttcctggggctgacgatcctgttgctcttccctttcacgcggctcgtccacatgctcagcgcccccatccgctatgtctggcgcccgggttatcaggttgtgcggacgcgccgccggcccgtcggcaaccaccccggcgccagccgccccgcggccgcccggcccggcacccgttgaacggaggcagagatggtcgtcatccgtcagagcccgcgtgtcgcggcggcacggtccgccgccgcccggcatgcccaccacgccgccagccatatgcacatggccgaccccgtccccgtttcggttgacgggcgggacatccccgaagaggagatccgggccgagatgcacaatcatccgggccccgacccggacaccgcccgcaatgctgcggcgcaagcgctggtgatccgcgagctgctgctgaacgccgcccgggcccgcgacatcacggcccgccccggcaccgacggccagggccggcaggagctggacgacgaggcgctgatccgcgccctgctcgatgccgaggtcaccacgccccaggcagacacggccgcctgccggcgccattacgacagccatcccgggcgtttcacgacctctccggtctgggaggcgcggcacatcctgctcgccgccacagagaccgacgaggccggccgcaaagcgacgcgcgagcgggcgcaggcgatcctggccgagctggcgagcgatcccgaccgcttcgcggacctcgccaccgccttttccgcctgcccgtcccgggcggagggcggccgtctgggccagctggtccgcggctctaccgtgcccgaattcgaggcggcgctcgcccggatgaacccgggggagattgcgcccgcaccggtcgagacccggttcggggtccatgtggtggcgctggaccgccacctgcccggcgcggtgctgcccttcgaagcggtggaggcacgcatcgccgcctggctcgaagccgcaagctggagccggggcgtcgcgcagttcatctcggtgctggccgcggaggccgatatccggggcgtcgcactggcaacggcggaggggccgctggtgcgctgacccggcggcagatccctggtgacaggcagaggaggaggtgcgggagcatggaaaccgaccggatcgcccttggcgccctgaccgagggcctgccgcccacgcttttcctctcgccgctcgaccggatcttcgccgatcatttccgccagcgcgccctgttccgcagcctggaccggatcgctaccacgccggatgtcgatccggcgctgatcaccgccgtgaccggcttcctcgcgaccgaggtcgagccccactggacggatgaggaagacgacctcttccccctgctccgcgcccgcgcgcgccccgaagacaggatccgccggctgctggcgaggctcgcccgcgatcacgacgccgcccggaccgcgcgcgcccggatcatcgccggcctgcccgaccccgccacccgccgcgatccggccttccgcgagatgctgaccggcttcgcggcggatgagcgccggcatctctgcctggagaacgccgtggtcctgccgattgcgcgggcccggctcggccatcaggatctgatggtgctgggccagcgcatggccgcgcggcgcggcgtgcccatcgccatgacggagtatgtgacatgacctcccccggagagtgcaactgcgacggccccgggctgctcgccctcgaccaggcggtggcccgcgccgtggcgctctgccggccggtcactgacaccgacgacgcgcctctggccacggcggcgggccggatctcggccgcaccgctcgtcgctccggaaccgatgccccgcttcgaccatgccgcgatggacggctatgccctccgtggcgaggatctgggcggcagcgggccgtggccgttgccggtcaccggccttgccgcagcgggcggcgccgcaccggcagcgaacagcgggccgcacgccctgcgcatcctgaccggcgccccggtgcccgcgggcttagaccgggtggtgatgcaggaagactgcacggccggggacgggatggtgacgatccgccgcgatcccggccccggcgccaatatccgccgcgcgggagaggatgcccgggccggccagatcctgtttccggccgggcggcggatcgacgccgtcgccgtggcgctcgccgccatcgccggccggccggtgctgccggtggtgcggcggacccgggtcggcgtgatgactttcggagacgagctggtggcgccgggcgccccacccggcccggcggcgatccatgattccaaccggccgatgctgctggcggcgctggcgcggcccgatgtcgcggcggccgatctgggcgccctgcccgatgatcaggcgatcatcaccgccgccatcaccgatgccgcgggccgtttcgacctgatcgtctcgaccgggggggcctcggtcggtgatcgcgatcacctgaaacccgccttcctcgcggccggcggcacaatcgagggctggcgggtggcgatgaagcccggcaagccggtgatgttcggccggatcgggggtgccgttttcctgggcctgccgggcaatcccgtggccgcattgctgggcctgcgcctgttcggcacggcgatgatccgccggttgcaggggcgcccggccgagcccccgccggtcatggccgccgccggcttcacccatggccgccgggccgggcgtaccgaatttctgcccgcccgcctcagctgccagccgggtcggcagcccgccgtcgtcaccaccggcggcagcggcgccgcacggctggtgccgctcgtcgccgccaccggatttgccgtcatccccgccgcgcaggacacggtggcgcccggtgaccccgtcggctggctgcctttcgccgacaccgatctgtccggagacccgtcatgaccgccaccgacagccccgcgccgcgcatggccgtgatcatggtcgatcgcggcattcccgccgatgccgtcttcgatcgggtggcagcccggctcagggcccggggcctgcgggtcggcggcctggtccagcgcgaaggccccgcacccgaaggctgctgcgccgccatggatctggaagagctggagagcggccggctgatccggatctcgcaggatctgggccccggcgcccgcggctgccggctggacccgcgcggcctggccgaggcggcgatcgcggccgaaaccgcgctggcccgcgggctcgacctgctggtgatcaaccgcttcggcaagggcgaggccgatggcggcggactgcgcgcagtgatggccgccgcactcgatgccggcgtgccggtgctgaccgccgtccgcccgcccctatgccgaggcctgcaccgccttccatggcggcatggcggccgaactgccggcggatgaggccgccgtgctcgcctggttcgcggagaccggatcatgagcatcctccacccgccaccgcccctgtcgggcgtggcagacgcggcccggggctgcccgctgatcgacagcttcggccgccaggtccgctatctgcggctctcggtcaccgatcgctgcgatctgcgctgcgtctattgcctgccggcgcaggcacgctttctgccgcgcgccgccatcccctcgctcgacgaactggccacgctcgccgatgtcttcatcgcagccgggatccgccgcatccgcctcaccggcggcgaaccgctggtccggcgcggcgtgatgaccctggtggcgcggctgggcgcgctggtcgcccacggcatgctcgacgagctgacgctcaccaccaacggcacccagctcgcccgacatgccgacgcccttgcggccgccggggtgcggcgggtgaacgtctcgctcgacagcctcgatcccggccgcttcgccgccctcacccgcggcggcgatctggaccaggtgctggccggcatcgacgcggcgcaggccgccgggctgcatgtgaagctcaacaccgtggcgctggcgggcgagatcgagcacgagatcgaccggctgatccgcttcgcccatggccggggcatggatctgaccctgatcgaggtcatgccgctgggcgagaccggcaccgatcgccgccaccagcacctgccgctcagccacttccgcgccgaactcggccaccgctggacgctcaccgatctgcccgaccgcacggccggcccggcgcgctatgtccggatcgaagagaccggcggccggctcggcttcatcaccccgctcagccacaatttctgcgaaagctgcgaccgggtgcgggtgtcggccaccggccggctctatacctgtctcggccatgaaggctcggtcgatctgctgccggcgctgcgtggcggcggtgccgcggcggccgaagacgtgatccgccgggcgctgctgctcaagccccgcggccatgatttcgtcgtcgaccgccaccgcgtgcagggcatcggccgccacatggcggcactcggcggctgacacgcgccttaaccgaaagccctctcccatgcgcatcggcatcctgaccatctcggaccgcgcggccgacggccgctatcaggatcagggcggcccggccatcgaggcctgcctttccgcccggatcaccagcccctggacacccgaccggcggatcgtgcctgacgggatcgagccggtttcggccgccctgatcgatctggccgaccgggccggggccgggctgatcctgaccaccggcggcaccgggccctcaccacgcgacctcacccccgaagccctcgcccgggtgatcgaccgcgagatgccgggcttcggcgaggcgatgcgcgccgccagcctgaagaccgtgcccaccgccatcctgtcgcgccagaccgccgggctgcgcggctcgacgctgatcgtcaccctgcccggcaaaccggccgcgatcggcgtctgcctcgatgccgtcttccccgccatcccctggtgcctggaattgaccggggccgggcggatcgatgccgccggtgccttccgcccggcctgacgcacagggagaaagatccgatgaccagccgcccctccggcgccgccctcaggcgggcgggaccgccgatcctgcacggtttccgcctgttcttcctcaccgcctcgatctgggcggtgctggcgatggcgatctgggtgccgctgctgcgcgggatcttcgccctgccgggcggcctcggcccgatcgactggcacgcccatgaaatggtcttcggctatgtcttcgccgtggtggcgggcttcctgctgacggcggtgcccaactggaccgggcgcctgccgctgaccggccggccgatcgcggtgcttggcctgctctggctggccggacgcgtcgccatggcatcggcgggcctcgccggcacaaccggcccctggatcacggccgggttcgatctcgtctttccggtggttctggcgctcgcgatcggccgcgagatcctggcagcccgcaaccaacgcaacctgaaggttctggtcctgctcgccctgctgatcgccgccgatgccgggtttcatgccgcgctgatcctggagaccgatacccggccctggctgcgcgccgggctgggggtgaccctgctgctgatcatgctggtcggcgggcggatcgtgcccagcttcacccgcaactggctggcgaagcagcccggagccggcccgctgccggtgcccttcaaccgtgtcgatgcggtttgcatggcggttgcggccatggccctggcgctctgggccatcctgcccgaggcaatggtcaccgcctgggcggcgctcgcagccgggctgctgcacatcgcccgccttgcccgctgggccggctggcggaccggtggcgaggcactggtgctggtgctgcacctcgcctatgccttcgtgccgatcgggttcctggccgtcgcgctgtcggttctgctgccgggcagcctcaccccgcaggcggcgctgcacgcctggagcgccggtgccgtcgggctgatgaccctggcggtgatgagccgcgcggcactcggccatggcgggctgccgctgacggccgggcccgccgcgcgcacggcctatgcctgcctgacggtcgcggcgctggcgcgggtcgccgccggcagcagccttgccggcgatctgaccatgccgctcaccgatctggccgcgggcggctggatcgcggggttcctgattttcatcatcggctatcgccgggtcctgaccggccacagcgccaagggctgatcgcggcggtcaggccatctccacccggttgcggccgttctgcttggcgcggtacatggcgcgatcggctgcggcaagagctgcctccagcccggcgccgtcgggtgtcaccagcgccacccccaggctggccgatccgcaataggcctcgacgccgggcccgagcggcacctcgacgccgcgaatggcgtcgagcagccgcacggcgatcctccgcgcctccaccccgtcgacatcggtcagcagcacggcgaattcctcgccgccgatccggcccagcagatcctcgcagcgcaggctcgcctgcatcacacccgccagcctggccagcacccgatccccggccggatgcccccaattgtcgttgacccgcttgaaatgatcggcatcgacggtgatcaccgcggccggccggccctccccggccagacggtcggtcagcgcccgcgccttttccatgaaggcggtgcgggcgagcgtgccggtcagcccgtcatgggtggcggcatgatgcaggcgctccatcagctcttcgcggctggcggtgaccgcgacgacggtgagcggcgccagcgcggtgagggtgatgccgatgcggatcgagatcatgtcctcgcgcgggatcggcgggcgcgaggtgcacatgccccgccgacaccatcagcaccatggcgagcgccgagaccagaaccagtaccgcggtgccgaacggccggtagcgcaacgcgcaccagagcaacgccggtaccggaaaggtcagcgccccggcaccgccgaccagcacggtggccagcagcgacagggccagtgccacggccggcgcccagcgccagggggcgacctcttccagccgcgggatcggcggccggcgccggcgttcggggcggggcggcagcgccgggggcgccgacgatgcgcccagccgctccggcatggtcaggatcaccggcaggatggccatcacgttcagcagatcggcaccgaaccagttgccgaaggcctcgaccggcgagcggccgaacagcacggcctcggcctggcaccccagcccggcaccgacggtcgcgaccgccagcgccgtgcccgccagcgccaacaccccggacgaccgggtgagcgccagctgcgcaggcgtgagccgccggagcagcagcacccccaccgcaaccccggccatgttggccgccgtcatccacaggctgacatccagcggcgaaccggtgagataatccgccagcacatagccgagggccgcccccagccaccccgccgggcctgatgtccccttccagcgcaacatcatgccgagcaggatcgcattggccggccagaccgccgccagaaagcccaccggccgggtgaagatcccgaacagcgcagcgatgaagatgatcaggaacacgaccccggcccgggcggggtggcgaagccaggccggcatcggccgggtcggctgcaacccggccggctgcctggtggcgatcggttcctgcggcgacatggcctgcccctccccctgtccgatgcgggtgcatcggacaggcgttctatcaccgtttcgctccggttgccaaagcgtacatgtggcgtggcagggaaggccttcgtcactcagtgattgaggagctgcgacagaaaggtcctggcgcgtggtgtcgccggatcggagaagaagcgggccggatcggcctgttcgacgaccctgccatcggccatgaacaccacccggtcggccacctggcgggcaaaccccatctcatgggtcacacagatcatcgtcatgccgtcacgtgccagcgtgaccatcacctcgagcacctccgagatcatctcgggatccagcgccgaggtcggctcgtcgaacaggatcatccgaggctccatgcacagcgcgcgggcgatcgccacacgctgctgctgcccacccgacagctgccccggatacttgtcggcctgatcggcgatgtgcacccgtgcaagacaggccatcgcccgttcccgggcggcacgcctggacagccggcgcacgcagagcggcgccagcatgcagttgtcgatcaccgtcagatgcgggaacaggttgaaatgctggaagaccatgccggcctcacgcctgacggcgtcgacattgtccagccggtcatcgagttcccggccgaaaacggcaatcgaaccgccatcatgctcctccagccggttgatgcagcggatcagggtggatttgccggacccggaaggaccgcagatcaccactttttcgcccagggcgacatccagatcgatctccttcagcgcctgatagccgctgtagaacttgttcatcccgcggatgaccacggccggttcctgcaacgacatggacgcactacctccgggacgagttcagccggtgctccagatgtgcaccatagcgggagagcgagaaggtgaaggcgaagtagatcagggcaacgaagagatagacttccagataggcgaagttccactcggcatcgccataggcggtggcacccgaggccagaacctcgaagaagccgatcaccacgatcagcgaggtttccttgaaggtgacgaccagctggttgaccgtcggcggcaggatggccttgaacacctggggcagcagcacccgcaggatgcggtcgcgatagggcagccccagcgccatggccgcctcctcctgccctttgggcagggcctggaagccgctgcgcaggatctcggcctgatagcaggcgaagaacagcgcaaagaccaggatcacccggtagagcttgtcgccctgaagccagccgggcagtgcaaagggcaggacgatcgccgcagtgtagatcagcgccagcagcggcagggcacggatggtgtcgatgatcccgccggtgatcgtcgccagcggctgaagcttcgaccgtcggaccagggcgagaagaatggcgagcggcatgccgatgatcaccaccgaggcgaagacgaaaagggtgagggcgagcccgccccaatcctgcggcgacagttcacgcagcccggcgaagccgccgctcatcaacaggtagaagccggtgaaaccacccacccacaacagggcgatccgccgcaggttccacatccgcggccaggcggacagcaggcctgcaccgatcagcagggcacagccgagcgccgaacgccactgctcttcgacgggatagaggccgaacaggatcagccgccagcgggcgtcgatcacgctccagcaggcgccggcatcggccgcccggcagagggcacggtccgcctggtcccagaccgccgagaccaccgcccagtcgccgaccctgatcacgatccagccgatcgcaaggccgaagatcaggctggcacagccactgcgccagctgcggaaatagccggcccgaagctcgccccatgaccgcggcaacaaccgcaccggggcgagccggccgcctgacatgcgcagttggtcgcccttcagccggatcacggcattgatccggttgaagagggtggccagcagatagttgatgcaccagaacacgaccatgaagatgccgatcagctcgaaagtctggccgctctggttgatcgcgttggaaacgacgaggaagaagtcggcgaagccgaccgcaaggccgatcgtggtcgccttgagcagccagacatactggctggtcagagtcggcatcaccgcccggatcgccagcggcaaccggatctggaagaaggtcgcggcatcgctcaggcccagcgccttcgaggcctcgatcaggccgcgatccaccgactggaatcccgagcggatgatctcggcgatataggccgagccgtagaccgcgagtgcgatgacgcaggccagcatctcctgcgacaggcggaagccgccccgcaggttcagccccttcagcgccggcaggtcgagcagcggcgtgcccggcacgtgggtcgcctggaagatggccaccgacaggcccagtgccgccagaagggccagtcccgcgcggcgaaacttcgtgcccggcgttgcaccacccctattggccagaagcagccagagggcggtggccacccctgcgaccatcacgacgcagatggcgatgccggcggccaccggcaggttcgccaccggcagatagacgccgcgattgctgaggaacagcgcatcgcccatcgacaccgcctgacgcgggggcggaagggcggtgaggatcttgtaccacagcatcagctgcaccagcatcggcacgttgcggaagatttccacatagaccgtgccggccaggctggcgaccgcattgcgggaactgcggatggtaccgatcacgacgccgaccacggtcgcgatcgagagcgacaccgcccccagcagcagcgtgttgagcaggccggcgagcagcgccttccagtaaggatcggtcggcccgaagggaatgaccgagaagccgagatcccagccggtcgcgcgccacaggaaaccgaaaccgctcgccatgccgttgaacgcaatggcggcccgggcattgccgaccagccagacgaccagggccgcgagggccccgatcaccaccatctgaatcacaaggctgcgggtgcgtgcggatcccagaccgttcagacggcgcctttccccggtcagcggaccggggatgcggggccggccccgcccgccgcgcgcgatctccgccatcagtcgaacgcgaccggatagtggacgccgccatccttccacagcgcattgatcccgcgttcgagcctgaaggccgactccatgccgagatcacgctcccagatctcggaataattgccgttcaccttgatgacattataggcccagtcgtcgggcagacccaggcgcttgcccacgccgggggtggtgcccagcatggtggcgatggccgcactcggcggattggcgcggatctcgtcgacattcttcgaggtgatgccctcctgctccgcaaaccagagagcgttgagcgcccagttggcaatgtcttcccactggtcgtcgccttctttcacgtaccagacctgcgcttccagagagaccacatcgggcaggatcagctggtcgtcgggggtcttcgcgttcatgcgcgacacggcgagcgtcgaagccgtgccgatgatcccgtcacagcgcccttcgaaataggccgacagcagttcttcccacttctcgtaggacaccgtctccagactgatgcccttggccgcggcatattcggcgatcacccgctcattggtcgaaccggccggcgcacagatcgatccgccatccagatcggtaatgtgcgcagcgcccagctccttgtgggtcatcacctgaaaggtgccgatgatgtaggggcgcgaggcgttgaagccgagttcggtatcgcggctctgggtccagccgctctgcttgatcaccacgtcgagttcgcccgactggagggccggccagcgctgggcccaactgatcgggatcagatccagatggccttcataggtgccgaagatcgcggtcgcgaacacccggcacatgtcgatgtcgaagccggtccagttgccggtgccgtcgacctgagcgaagcccagctggctgccggtatgggccgggcaacggagcgcgccacgcttctggacctccgccagcttgcccgcagccggccttccctctgcatatgccgcatgacccgacatcaccagacaggcgagaccgacacccgccatgattcccttgtacatctcccgttctccctgtcgttgccggacgcccttcccacagacgttccggtggatgatgctctcgccctcaagatgatctgaaatgatcagagctgcatttttgtcgacttcaaatccatcatctccaggatcatcgtcacctactctgcgccccggctgccttttatcccaaattcattcttttgggtggctcatgccttaaatgcatggattgcggtcacgatgccacctgcaaaggagcctcgaggtcacgcagaatctgcaccagccgatcgatctcggtggcatcgagcccggtgaccggggtgcgcaacacgccgccatccgtgccctgcagcttcatcgcggccttgatcgggctcgggaagcttcgggtcacgaggcccagcgccagcgggttcagcttctgctgcaaagcccgggcccgggcgacgtcaccggcggccacggccttccagagatcgacggtcagttcgggcgccacattggacgtgtaggtgacggcaccggcaccgccggcgaagccaagctcggcgatatagctgtcccgtgaggtatagaccgccacccgcggtgacagccgccgcacgccttccgatgcctggagctgatcgccttccttcacacccacgaaatgcgggctcacctcggcgatcgcctccaactcgtccaggctcagcatcggcgaggtgtaggtcgtgttgtagacgatgtagtcgagatccgagacgctgcccatccggcggaaataggccacacgttcggcctgggtcaggcggtagaagaacggtgccaggatcatcaacccctgagcaccgatcgcttcggccgcgcggatgtcctcgacggtctcgaagtccccgacactgccggccgtggcgatgactgcagcccggccggcgagggtgtcgacggcacagcgcagcgcgtcgcggcgttcggccggccgcaggctgccgccctcgccggtgaccgcgttcatcaccacacccgcacagccggcatcggccagccggaccagatgccgcgcaagggcgtcgaaatcgatgcggccgtcggaatcgaacggcgtgatggaggctgccagaatgccctgcaaactgctcatgccctgcgaactgctcatgtgggtctccggtatctcagacgaaacggtggacgatcgggccaggcaacggacacgggctggctgccctcgcccgcggccattgccgggtcggatcggaaaggaacgggaagctcgccgctcagtcgatggcggtcgccgccaccgcgggatgtgctgcaaatgcgtcgaaccagacggccaggcccggccgggtgtcgcgccaggccagatcgccgaggcggaagtccagataggcaagcgcgcagaacaccgagatcgtgccgatgtccatccgctggcgaagtccctcggcttccgtttcgaggcaatcgaggccgtcgacgatcttgctgcgccaggcctcgatccatgccggccagcgcagggcctcgggacgcagggccgtctcgtaacggcactgaagtgccgcatcgaccatggtatcggccagtgcggcctggcgctgattgcgccacaggtcgtcgccggtgcctatcacgccccccccggcaaccatgtccagataggcgcagatcaccgggctgtcgaacaccacggtgccgtcgtcggcgatcagcaccgggatctggcccgacggattgatgcggcggaaatcggggtcacggcgggtgagatcgcccggcgtgcggatcagttccagacgatcggccagacccaggagatgggcgacgatcatcaccttgcgcgcgaagggcgagcttggggagtgatgaagcttcatggggtcctccgggcggccgcggggaagagtcggaacctgccggcggaatagggtgcgagatcgagcgccggcacttcgtccgcagccagcgccgccaccagccgtgccgtggccggcgccatcgacggaccggcatgaccatggccgaacgcatacaggacctgcacgcagcgtcgggcgcggccgatcaccggcaatccgtcgggggtcgaggggcggtggcccatccagcgatcgacccgcacctccggcgcgccggtatcgagccccggcaggccacgcgcggcatggtgcaggacgatatcggcccggcgccagtccggagccttgtcgacgggcgccagctccacctgtcccgccgcccgaaacccgccgggctggggtgagacggcgatcttgccgtcgctcagtatgaccgaatgccgcggaccgacgctggcacctgacacatggacatgatagccgcgctccgaggccagcggcaccctgtcccccagtttgcgggcaaggacatccgagcggatgccggcagcgatcaccgcatggctgcacggcatcagtccgttatcggcctccaccgccaccagccggccggcctcgatccgaaagccgatcgcgcgcgccgccagcacctcgccgccaccacgaaccagcagcgccgccagcgcctggcaatagccggcggtgtccgcaagccaggctccatcctcgatcgaggtggcgaagccatagccctcggcaaggtcgggttcacgcgccctgagatccgcggcctcgatctcgcgcagcccgatgcccagccgcgcccggattcctgcctcggccttgccggccagataggtttcccgcctgcgaaaaaccgtgaccagaccatcgcgccggaccagttccggcacaccggccgcctcggaccatcggacatagtccgaaatcgcatcgcggcagagggcgtagcgccgcctggcgcaggcctcgaccttctcccagctgctgcccgccagcaggaaacgcaccagccagggcgcaagccgtggcagatccatcggcgacagatagaacggcccggtcggatccatcaggaagcctggcaccttcttccacaatcccgggaccgaggtcggcatgaccgatgccggattgatccaggcgccatgaccataggatgcggattgccgcccgcctgccggcccgggatccagcaccaccacctgccggccgcggcgctgcagttccagcgccacatgcaacccgacgatgccggcaccgatcacgacacagcttccggtcatgttctcgccccccatggtcagcgccccctccggcgcagcccggccatctcgcggacgtccttgcggtccttggccgccacccagcgcgcggccacgaacgggctcagaccatggaagggcagcggccgcatcggctcgaagggaatggtcagcgcggtttcgggttcgcccagcgcatcgcgggcaaggtcgcgcccgaaggtcgtgcccatggcgacgccacggccgttgcagcccagcgccgcggtcacgcccggcgccagacggtgaagcttccaggtgccggccaggctcatcgccatccagccgctccagcggatctccggatccagccggaccggcgccagctggggaaagatctcctccagccgtgccacgctacgggcaagatcgggtccggtgtcatggccgaccggcgggccatagccgttgaaatggatccgcagatcgctggtcaccctgagcccgatcagcaggcggcgacggtcggtcatcactgccgccccgggcaggacgctacgggcgacggcctcggacagtggttcggtcgcaaagtggtaggaccgcgccggcaccaccgtccggcgcagtcccggccagaggtcgtcggcataggcatttgtacacaggatcacccgggtggccgtcacctggcctcgggcggtacggatgatccagcgcgggccgtcggccgcgatcgacagcgcccggctgtcctcgaacaccctggcgccgaagccgatggcggtacggaccaggccacggacataggccatggcgttgactgcaccgccacgttcatccttgaaagcgcccagatagagccggctgccgatctgccgggcggcctcgtcgcgatccaggaacctcaccggcttgccttcgcgggccatgacctccgcccgggccgacagctccgccgccgcagccggggaatgggcggcgacgatcacgcccccccggcgcaccccggcatcgaagccgtgccgctccgccaggccgaacaccagatcgggccccgcttcgcaggcttcgttgaaacgtggtccatgcagggggccatagcgccgcaccgcctcgtcgaggctgagcttcgaagccggggccacatggccggcattgcggcccgaggctccccagccgacggcattcgcttccagtacgaccacggacgcacctgccccggccgcgtgcagcgccgcggatgcgccggtgatcccaccgcccacgatcgccacatccgcgtccaccgcaccgaccagggccggaaggtcgagcggcgcaccggcgcgagccgtaaaggcggtacgtggcaggtcgcgtggatcggaattcgggctgtacacgggcggcattccctgagcgaggccagcgtcggcacggccaggccgcatgacgcgctaccccctgagcctaggcccggcagagacctgccacaaatgcatctttccccccatgtcatatccattttggaatgagctgtatgacctcaaggttctggagatttcagggggccggatgcctcaggattccggatgctggccgatctgcctggctgcgaccgcctgaacatgcgcgatgaaagcctctgcaaccaccgagagcggccgctgctggggcaggatcaggcccagcgcgatcggcacatgcggttcgaacggcaccacctcgaagctctcccggccgtcgcggaacgagaccgaaaaaggatcgaccaggccgaccctgtcgccgatctcgacgaatttgcgcacgatgtggctatggttggtcgcgatcacctgattgatccagatgcccgcctccgccagcgaggccatgatcaccgcgcccaggcccagcgttcccggataggacacgaacgccaccccgtccaggtcgcgcggcgtgatccgtctccgtccggccagcgcatggctgcgcggcaccagacagacgatcccggcactgaccagggtgtgtgtggtcagatgctcttccctctgcggatagtgcacgaaaccgaaatcatagagcccctgggcgaccattgtatggatcttctcggcatcgaccacgtcgacctggatctggagcgtcggatgttcgtcccggaaggcctcgatcgcgcccggcagcagcgagataccgaaggtcgcgagggtggcgatgcgcagggtcggcttgcgcagcggcgaattcgcccgtccgaaggtttcgatcagatcgatctgctgcatcagtcgggcgacatgctgtgccagcagttcggcctcgggcgtgggccgcagcttgccgccggtgcgcacgaacaacggtacgccgaccgtttcctcgatctgcttcagcgtcttgctggcattgggctgggtggtgttcagctcgtcggccgcctcggtcaccgagccggtcttcatgtagacgaggaaagtctccagctggcggatcttcagacggtgcatgggtatccggcgggcgacaggaaaaggggcagcacctcattctatggccgatgcggggtgggaaggcaaatccgccggcaccgacctctgccggctgtttctttcgcacctgcgtaatcccacgtacgcagcccgccgtattttcgcagcgcagcaaatccccgaccattcgatggcgcgatgcggaccgttcccccggcggccgtgtcccgaagctccatcgatcaggaggggacatgaccctgacccattcagcgggccacgcgccccggttcggcctgaagcggctggcggccgcggtggccgtgtccgtcaccacctcgctggccgccatggccggcatcggcgacgtcgcgcaggcggcaccggccaccgccgaggtcaacaccacgggcctggccgtcaccgataccgaggtcaccgtcggcatcctgcactcggtcaccggcaccatggcgatctcggaaaccgggtcggttcaggcggaaaagctcgccatcgagcagatcaacgcctcgggcggcatcctgggccggcagatcaagatcattcaggaagacggcgccagcgactggccgaccttcgccgagaaggcccgcaagctgctggtcaacgacaagaccgcggcggtgttcggctgctggacctcggccagccgcaaggcggtgctgccggtgttcgaaaaggaaaacggcctgctctactacccgaccttctatgaaggcctggagcagtcgcccaacgtgttctacaccggccaggaagccacccagcagatcctggcgggcatcgactgggtgatgaaggacaagggggccaagtcgttctatctgctcggctccgactatatctggccgcgcacctcgaacaagatcgcccgcaagcatatcgagatgaacggcgcccaggttctgggtgaggaatacttcccgctgggccacacccagttcaattcggtcatcaacaagatcaagctgcgcaagcccgacgtgatctacgccatcatcgtcggcggcagcaacgtcgccttctacaagcagctcaaagccgccggtatcgacctcagcaagcagaccctgctgaccatctcggtcaccgaggacgaggtccgcggcatcggcggcgagaacatcgccggcgcctatgcggcgatgaagtacttccagtcgctcgacaacgagaacaacaaggcgttcgtcaaggccttcaaggacatgtggggccaggacatggtgatcggcgacgtcacccaggccgcctatctgggcccctggctgtggaaggccgcggtcgaaaaggccggttccttcgacgtcgacaaggtccgcgaggcctcgcccgggatcgagctgaccaccgcgcccgaaggctatgtcaagatccacccgaaccatcatctgtggagcaaaacccgcatcggcctcgccaagcccgacggccagttcgaggtgctctacgagaccgcagagctgatggagcccgatcccttcccgaagggctatcagtaaagcgcggaccggcggcagggcgcgggcagtgcttccccctgcccgcgcctgccgccgcaaccggccgaagccgctcccttttctcccgcgcctgcccccctcacactctcctcctcccgctctcccccacccgttcctgtccatcccaccacggcgcgcgccgccccgatcggggcgctgccgccgtccgtccgggaggtgtcgcatgttcgacggctacacggcgtcagagctggtctcgatcctggccatgcagggcttcgccggtctgatcctcttctccgtcttcctgctgatggcgctgggtctcgcgatcatcttcggccagatgggcgtcatcaacatggcgcatggcgaattcatgatcctcggcgcctacatgacctatctcacctcgcatctggttcaggactacgcgcccggcctgttcgggggctatttcttcctggccatgatcgtggccttcatcgccgcgggtgcgctgggcctgttgctggaatgggcgctgatccgccatctctatcggcgaccgctcgacacgctgctcgccacctggggcgtgtcgctgatcctgcaacagctctaccgttcgatcttcggcgcccgcgaggtgggcgtcaccctgcccgactggatgatgggcgcgatgtcgctcaccgacacgatcgaggtgccgatcaacggcctgttcgtgatggcgctgacgctggtcatctcgggcatcgtcttcctgctgatgttccgctcctcatgggggttgcaggtgcgcgcggtcacccagaaccgggtgatggcgggtgccgccggcatcaacggccgccgggtcgatgccatgaccttcgcgctcggctgcggcatcgccggcgtcgcaggctctgccttcaccatgatcggctccaccggcccgacctcgggccagctctacatcgtcgacaccttcctggtcgtcgttttcggcggcgcgcagagcctgctcggcaccatcgcctcggcgctcaccatctcgcagtcgcagtcgacgctggaattcttcctctcgggcagcatggccaaggtgttcacgctgctggtggtggtgctgatcctgctggtccggccgcaggggctgttcgtcctcaaagtgcggaagggctgagacgatgaccgatgccgtgacccggaccgcctcccccgccgccatccccaccccctcgcgcctggcgctcatgctcggcacgaagcgggacatgatcgggatcctgctcttcgccgtgctcatcctggtcgtgctgccgctcggcctcgacctcttccggctcaacaacatcggcaaatacctcacctacgccttcgtggcggtgggcctggtgctgtgctgggggctgggcggggtgctgtcgctgggccagggggtgttcttcggcctcggcggctatgccatggccatgttcctgaagctcgaagcctcgtcgcccgaagccaccgccatccagtccacccccggcatcccggatttcatggactggaaccagctgacgaccctgccctggttctgggagcccttccacaacctggcattcaccatcctcgcggtcgtggccgtgccgaccatcttcgccttcttcctgggggccatgctgttccggcggcgggtgggcggggtctatttcgcgatcatcacccaggcggtcgcctctatcctcaccatcctgatcatcggccagcaggggctgaccggcggcatcaacggcatcaccgacctgcgcaccctgctcggctgggacatccgcaccgatgccgcgaagtacatcctctattacgtcaatggcgggctgctgatcctggtcatcctggcggcgcagttcatcaagaacggcaagatcggccgcatcctggtggcgctgcgcgacaaggaagaccgggtccgcttcaccggctacgacgtcgccgcctacaagaccttcgtcttctgcatcgccgccgccttctcgggcatcggcggggccatgttcaccctgcaggtcggcttcatgtcgcccagtttcgtgggcatcgtgccgtcgatcgaaatggtggtgttctgtgcgctcggcggccggctgtcgctgctgggggccgcctatggcgcgctgatcgtcaactacgccaagaccagcttctcggaaagcttcccagaactctggctcttcgccatgggcgccctgttcatcggcgtggtcgtggccttccccacggggctggccggcctctggcagcaatatgttcagccgctgatcgaccgcgcgctcacccgccgcagccccaccgcccccgcgggccccgccgcaccggcgccgggcgagtgaaggagacccgatcgatgaatgcagccgcagccaccacgatcgtcggcgtctccgccaccaacaacgacttcctgctcgcggtcgaaggtctcaccgtctccttcgacgggttcaaggcggtcgatgacctctctttctatgtcgaccgcgacgagatccgcgtgatcatcggccccaacggtgccggcaagaccacggtgctcgacctgatctgcggcaagacccgggcgaccgccggctcgatccggttcgagggtcgggaactgacgaagatgtccgagcacgaaatcgtccgggccggcgtcggccgcaagttccagaccccgtcgatctacgaggatctgaccgtcttcgagaacctggaactctccatccccggcacccgccatgtcttcaaggcgctgggcttccggcgcgaccgggcggtggtggagcgggtgacccggatcgcggaagagatctttctggccgatcagctcacccgccgcggcgacgagctggcccatggccagaaacagtggctggagatcggcatgctgctgatccaggacccggccctgctgatgctggacgagccggtggcggggatgagcgtcgccgaacgcaccaagaccgccgatctgctcaaccgcattacccgcggccggtcggtgatcgtcatcgagcacgacatgaacttcgtcaaggacatcgcccacaaggtgaccgtgctccatcaggggcggatcctgtcggagggcgacatcgacaaggtgcagtccgacccgaaggtcatcgaggtctatctcgggcattgatcgcgcgtcacgcgatccggatcgctcgtactataaccgcacatgtgcatgaattgcccgagggagatccgccatgttgaccgtcgatgacctcaccgtcgcctatggccagtcggaagtactccacggcctgagtcttagcgccgcaaaggccgagatcgtcgccgtgatgggccgcaacggcatgggcaagaccacgctgatgaaatccctgatcggcatcctgccggcacgcggcggccggatccggctgggagaggccgagctggtcggcaccgagccccatcagcgggtgcgcgaaggcctggccttcgtgcctcagggccggatgatttttccgaccctgacggtggaagaaaacatccgcaccggcctggtcgcccgcgggcggcgccacattcccgatgatatctacagcctgttcccggtgctgcacgagatgcgccgccgccgcggcggcaatctctcgggcggccagcagcagcagctcgccatcgcccgcgcgctggtcgccgaaccccgggtgctgctgctcgacgagccgaccgaaggcatccagccctcgatcatcaaggacatggcgcggtcgctgcgcgagatccgcgacatgatgaacctcaccatcctggtctcggaacaggtgttgagcttcgcgctcgacgtcgccgaccgcttcctggtgatcgaaaacggccgcctggtccacgaggaccgccgcgccgacgtcaacgaggcccgcatttcagcctatctctcggtttgagtgtgtccctcgccgggcggccactgccgtggccttggccgccgcctcaatggcgggactctgttagcccctctgcccaagcgggcgcatccgcgcccttggccgccgcctcaatggcgggagtctgttagtccctcgccgggcgggcgcatccgcgcccttggccgccgcctcaatggcggcttcggtggccggaaccggccaccgccccgtcaagccccgaccacccgtcttcccgcttttttcgtcccgcaatccgatcagaaacggagcgccgcatgactgaaacgctcgtcaaggtggacctttcgtcttcggcctatgagaacgagaacgtccacaaccgctggcacccggatattccgatgatcgcctgggtgaagcccggcgaggacttcatcctggagtgctatgactggaccggcggccagatcaaaaatgacgacgacgcggccgatatccgcgacgtcgacctcagccaggtccatttcctgtcggggccggtgggtgtgaagggggccgagcctggcgacctgctggtggtcgaaatcctcgacatcggcacgctcgacggcgcacgctggggcttcaacggcgtcttcgccaaggagaatggcggtggctttctcaccgagcacttccccgatgcccgcaagtcgatctgggatttcgaagggttgttcgcgaagtcgcgccacattccgggcgtgcgcttcgccgggctgatccatccgggtctgatcggctgcctgccctcacaggatctgctcgacacctggaacacccgcgaaaaggccctgttcgacaccgatccaggccgcgtgcccggtctcgccaacctgccctatgcgcccactgcccatatgggccggctgaagggctcggcggctgaaaccgcggccgcgaccggtgcccgcaccgtgccgccgcgcgaacatggcggcaattgcgacatcaaggatctgtcgcgcggctgcaagatctatttcccggtctatgtcgacggcgccggcctgtcgatgggcgatctgcatttcagccagggcgacggcgagatcaccttctgcggcgcgatcgagatgccgggctgggcgcatctgaaggtcgatctgatcaagggcggctgtgcgaaatacgggatcaggaacccgatcttcaagccgagcccgatcaagccgacctataacgattatctgatcttcgaaggcatctcggtcgacgaggctggcaaacagcattatctcgacgtccacatcgcctatcgccaggcctgcctgaacgcgatcgaatacctgaccaaattcggctattcgcgcggccaggcctattcgatcctgggcaccgccccggtcgaaggcaagatttcgggcgtggtcgacgtgcccaatgcctgcgccaccctgttcctgccgaccgaaatcttcgatttcgacatctcgcccacggcatccgggcccttcaagggcgtggagggcgccgaactgccgatcgccttctggaaggacaaggcctgatcccacccggcaccggccggcctgtcgccggccggtgccccacgccccgaacgaccggagacgcctccatgccgctctatgattacgcctgcccggcctgcgccaccgaattcgacgccttccggccgatgtccgatgccgcacgccccagcccctgccccgcctgcggcaccgccgcgccgcgccgcatctcggccccgcgcctcgccggtctgtcgaaagcggcactcgccgcccacgcgaccaatgaacgcgcctcgcacgaaccccgccgcagctcccatgtctgcggccccggctgcagccatggcggcggctcgaagggcttctccgccgtggcagagaagccggccatgaagacctttccggcgaagcggccgtggatgttcagccattgatcgggcatcgcagggcattggtgacggaccacaggccatggtagataaggggcaggatcagaacgcgccgggatatcgcccctcatggtcaatcagtccaccgccatcatgacgattgatttcggcaatgcccatgatcgccactggaacgatgcggaaacattgcgggaaaatggccgcctcgcgaatgccgatcatttgtacggcttcagcgccgaatgcggcctgaaggcattgatgcagagtttcggcatgtccgtgcatgacggtgaaccagccgaccgcggagactggaaacatgtcgatcagctggccgaacgatacgaaacctatcggtcgggcagtacttgccctaatgcagccagctatatactggtcaatgacaacgcgttcaacgactggcgagcatcacagcgatatgctgtggaatcggccttcacccaagaccgcgtggatgcgcatgccgcaggcgcccgcgaggttcgcgacctcgtcaagaccgcaaggcgagaggggttgctttgatgatcacgttcgacgacatcgagccacaacttatctctctgctacgagcacaccgcgaggtcctggcgccccttggttcgttactgatcaaccgagatctgaacgggcgcgtgcgaatcatcgctcaggaagactgtctcgcggatgatacccggcgagcgcttctggacgcactcgccgccgatatgcggaaacgactgggcacacatgtcgcccatgaaggctcgctcattctgtatgagccggatctcgccgccgttgcggcctcggggctctctcgcccgcttgccgaggatctgcccgaataccgaatcgtcgaccggttggcgaccggaacccgctgggccactgtcgaagagccttccagcggtgccgcgcgtcggatcgtgttcttttcgatcaagggcggcgtcggccgttctacggctcttgccgcctgcgcccggcatctctcccagcgcggccgcaaggtgatggtcgtcgatctcgacctcgaaagtccgggtttgtcctcctcccttctgccggatgatcggtgcccccgctacggcgtaaccgactggatggtggaggatcttgtcggcaatgccgacgagatgatcgaacacatggccgccgtgagcgacctgtcggagctgggcgatatccgcgtggtacccgctcatggtgccgaaccgggagattacctgctgaaactcgggcgggtctggatgcccagggtcacggccgaccgcgccacggaaccctggccccgccggctcaaccgcctgatcaacgccctggaggcgcactacacgcccgatgtcgttctgatcgacagccgctccggcatcgacgagaccgcctctgccgtcgtcacggatcttggggcgcatcttgtctgcctgttcgccatccacggcgcacagacctggaccgggtaccggatcctgttcgagcactggaagcgcgcaggcgtggttaaggatatccgggaccgcctgcagatcgtggccggcctggtgcccgagatcggcagtgtcgcctatgtggatgcgcttcggcaggcgtcatgggatctgttcggtgagtgcctttacgatgaagtcgaggctggcgcgacagccgaattcagcttcgatctcgccgagccggatgccccgcatcagccatgggccatccattggaaccggggttttgccgcccttgagcgactgcacggcaacgaggtcgtggtagacgatgaacgggtccgtgcggtattcggggaggtgttcgacggtctggacaaactgacgcccgcagaggactgatcacatgacacctgcaatgcttcggcgcgcattgatcgatgggttgccggaggtccaggcgcaggacggaaccgcgccggcggcagcacaagtctacgtaccgaatgctcatgcgcgggcactcgccctggattgcagcctggtgatcggcgcccgcggtgtcggcaagaccttctggtgggaggctctgcgtgacaacagggtgaaatcacgcctcgccggcacgatcaaatcaatcgacaacgtcaccatcggcactggcttcggcattggcgtcagcatagacgacgccccggatcgccagaccttcgcccggctgattgcgccggagagcggcttcaaggcctatgatgtctggcgtaccatctgtgtccgctggatccgccaccttcttgagattccatcgcaatcccaaccatggaaccagtcggtcagcgaggtcgcctccgatcccgagatgtatgctcgcctgcttgaacaggcaaacaaccgtcttcgccagcaggcacgccacgggcttctgatattcgatgcacttgatcgcacgagcaacgactggcggacaactgatacgatcgtgcgtgatcttctccggtttgcccttgatcttcagtcttatcagcatctccatgcaaaggtttttctcagacaggaccagttcgagggacgttccatcaaggacttcaccgacgcgtccaaacttctggccacacgggtggaactcacctggggtagcctggatctcaacggccttctctggcagtacctcctgaacaccccggccaacatctccgggccgatcgtggatctgctggcgaagctggggtgcccggtggacgcggatgcggacgtgcgtgaagtcccgccacgtctcaggcgtgaggaggctcctcaaaaggcggcattcgcgcacctcgccggccagtatatgggccgcgaccggcgacgcggcattccctatacctggattgtcagtcatctgtcagacagccaggggcgcgcgtcgccgcgatccttccttgccgctttgcgtcacgcagctgtcaacaccagcgaaaatcatcctgaacataccactgcactacactatgatgcgatcaaggagggggtgcgcgccgcctccggaatccgcgtggatgaaatggcggaggactatccctggatccggcatctgatgcagcctttgcgtgggatgagcgtgccctgcagcttcgacaacgtcgcaatggcctggagcaccgcgaaggtacttgaccagctcggcacaccggatgatcgtcttccaccggagcatctggaccagggccccgaaggtgttcgggaggacctggaaaagctcggcctccttcaacgcatgcgtgacggccgcgtcaacatgcccgacctctaccgcgtcggtttcggccttgggcggcgcggcggcgtgaaaccggcggcgcgcgagtgaccgccattgccataacggtaaccgcccggatctccacctccccccttgcccctgccgcccgcttcggcgaaagttgcgccgcaacaggccatggcggccggtcgacggggacaggtggatgacggaaagcgggatcgatcccggattggcggccctggccgtggcggtcgcgcagggcgtcggcggcccggtggcggcagcggcgcagccgatggacctgggacccgacggcccgcttggcaactggaccgagacggcgcgcctgattacacgccatcgtgtccaggggctggcctcgcccaccctgctgaaggtgtcgggcggtgcgatgcctgttgacctcaagaccagcctgatccgcgcgaccatgctggccgtccaggcccagcgcaaacagatggatctgatgttgcgcgtgttgaccgcactgcaacatcacggcatccgggcgatggcactgaaaggggccatgctcgggcatcgcttcatgacgcgccccgaactcaggctgtccaacgatctcgacatcctcgtcgatccggcgcgcatcgatgatgccgaggccgtcatcgcgagcttcggctatgcccggcaccttccaccgcaggactggcgaccggcctgggtggcgcattaccgcaaatggcgcaaggacgccgcctttctggccacggaaggtggcccgatgatcgagtgccattggcggatcttcgacaaccgcaagctgctgcccttcgatttcgacaggctgtggcagggtcgccacgtcgaaacggtgaacggcgtcgacgttcccgtgatcggcaacctgcaacagctcgtctatctggcggtgcacggcgcctaccacgcctggttccggctgaaatgggtggctgacttcgccgcggttttttgcgccacgtcgcccgaagaccgcagggccgcggcagcgcttgcccgggaacagggtgtcggcccggtcttcgaccatgcgctgtcgctcgcccatcgtctcttcgccataccgctgacggccgaagaggcggaccgtgtcgcccgtgccccccggcgcgaagcgctcgacggcttcgcgctggaggcgctgcaccatcacgatgcctcggcggtgggcctcgccgtggaccggcgcttcgcgctccgtatggttctgcacagctatcggctgcggcgcgaaccgggatttctggcggcccagatcatcatggatctcaacttccccggcggcctcgaaagcgccggcctcggcgatcgctggctctggctctacccggcggttcgcggctggcgatcggcccgccaccatatcgcccaccgcctgggacggcaggcccgggcatgaccatgacctcaggcgcggcgttccgcgatctcatccgccgcatggtgcgggccggcgggcgccggcgcgtcgcgaagctcgccggccttcagctgggtgcggcggtgtccgaaagcctgggtctcgccatgctgctgccgctgctgcgcatgatccagttgccgggcggcgatgcaccagcggagctgggcgaaagtgccggcaccggcatcggaccgctggaccagctgatcggggcgctggacccggccgcggggctgatcgccgtgctgctgatcttcgtcatcctgaccgtgatccgcggcctgctgctctatggtcgcgaagttcacagctttcatctgacggtggatctggcagcccaattgcgggctgacctgttcggcgctgccgcccgtgcaccctggcgggttctcgcctcggaaccccggggtcatctgcttggcctgctgaccaccgaggtcgaccggatcgtgaccggcacggtcatgctcctcaggcttccggccctcggcgtgatggccgtggcgcagatcaccgtcgccgcgctgatcagcccgacccttaccctggcggcactggcgatcggcggcctgagcggggttgccgtccgccgccgctccagatcgagcttcgcgcaaggcacgcggcagaccggcctgcacgcagccgcctcccgcgaggtccgcgacttcctcgacgggctgaagcccgccaagggccagggcgtggaagcacggcacgccgcggtctcagcgaccgccctgcgcgagaccgggctcggcatgctgtccttcatccgggccagcgccaatgcccggctgatgatgcaggtggtgggcgtcatcgccctgtcgggcctggtggtggtaggcgcgctgatcctgaaggtgcccggccccgagctgatcctgcttgcggtgatctgcggccgcctgctccccatggcgcaagaattccagcaatcggcccagagggtcgcgcatatgctgccggcgctggtggcggtgaacgccgccgccgcccgcctggcgcgccaggcgggaccggcggtcgtccgtcccgccctgcccgccgccgatcacccccccgaaatccggctggagggcgtgaggctcagccatcccggcgatccctcggcgcccgagacgagcggcagccagacggtgctcgacggcgtcgatgcgagcttccgggccggcagcgtcaccgcgatcatcggtccgtcgggtgccggaaagaccacgctgatcgacctgctgctcggccttctgccaccggatgacggcaccgtcaccttcgacggccggccgctggacgaagcccttgccgcggcctggcggccacgtgccggctgggtgccgcaggagaccttcctgaccgatgccagcctgcgccagaatctgctctggtccgccgatcccgagcgccatgcgaccgacgatgcggcgctgatgatggcgatagacgcagccgggctggcaccggtggtcgccgggctgccggacgggctggatacgccgctcggcgatcgcggcagccggctttcaggcggcgagcgccagcgggtgaccatcgcccgtgccctgatccgccagccgcggctgctgctgctcgacgaaccgtcaagcgcgctcgatgccgaaaccgagcagcgtctctgcgccactctggcgcgactgaaagggcggacgacggtggtcgtgatcactcatcgaccggccatcctggaagtcgccgatcaggtgctgcgcctggaggacggacgcttcgtcaccgaagcctgatcgcgcgagaggcacttcagcgcctcaccggtggggcgagtccttgacggaatttcataggcatcctattaatttgccatgacagatttcgatgacctgaccgccgccccttccgagcagattgccgacgccctggagcgtctggcggcggcctgccgtgcggttgcgcgggatcgcgatgccgctgcggggctggcgccgcttcaggcgcagctgctgacattgctggcacgacgcgggccgtcgagggtcggcgcacttgcccatctggccggcctccgccagccgacggtaagcgatgcgctccgcccgctggaagcacgcggcctgatccttcgccaaccgctggcggatgacgggcgggcagtcgcagtctcgttgactgcagccggtgccacgcttgccgccgtcatcacccgtccgcccgccgccctggtcgacgcggcagccaccctgccgtcagaccgcgcgccggaactgctgggcgacctgatcaccatgatccatgcgcttcaacaggcgggcgtgatcgcaccacaacggctctgcgtcacctgcgcgcattttcgccgcaatgccgggcccgacacagtccgcccccatgtctgtgccctggtgggcgcccccctgggcctccgccatctcagggtcgactgtcctgaacatctcgccgcctgacgcgcctctctgccccaagcgcccctccccctccagatggacccccgacatgcagcgcgatacccctgccggccgcctgccggcgcatccttccgaaccggaaatctctttgtggttgaatacgcctgcgccgatccggttgccggatctggaaggccggctcgtgatgattctggccttccagatgttctgcaccggctgcgcccgcgaggccgtgccgcagatgatgcgtgtccgccagacctttcccgaagaccgggtagcggtgatcggcctgcatacggtgttcgaacaccatgccgccaacacggtcgaggcgctcaccgccttcctgcatgaaaaccgcgtcaccgtgccggtgggcattgatgcgccggggccccgcggcccgctgccgctgacgatggcggcctggaacctgcagggcacgcccagccttatcctgctcgaccgtgccggccgggtgcggcgcaagaccttcggtcatgtcgacgacctgcgtcttggggccgaaatcgcctggctgctggcggaagactgatcgctgcctcccgtcagaactccggcgtgatgcggagcttcgtctccggcttgggaaccagccccttatggtcgcgcaagggcgtcggccagtcgtcacgcaccaggcgcatcagccgatccatccgccggaaaacctcctgccggtcggccggatctgactggaaataactggccggatgctcgagggtgcgggcgatgaaggcggcatagctatcgggatcctccgcatcgccccagaccggtgcggcaccctgaagtgccgcctcgaaggccgcatagaggctgaggaaccgacgccagcgatggtcgtcgaaatcgaaattcgcggcgtcgggcccgtccgcgggcgcggttccggtcatcagcaggccggcgcgctgcccaagatccgtcagggtccggatggtttcgggcggcatcgccaggttcagcccgccctcgtcgggcttcagatagatatgggccacccgctcgcgatagccgggcagcacggtgcgcagctcgtcctgccattcgctggcggcattgaacagcgacatcacgaaaccgcccaggctgcccacggtctgcaacgcgatccactggccctggatcgccggcatcggcagatgcacccgccgcttgggtcggtcttccgaatactggtccaggctgatgccgaaggtcgggcgggtgggcagcagggcatcgaagaaatggatcgggaaattgctcgaaatcccgccatcgctgaacagcagccggcgcatcaccgccttgccgtccgcctgtttcgtcggccagtcgatccggtagagcgggatggccgagatcaggaaggggaagctcaggctcatcctggccgccaccaccaccggcagatcgccgggggcgggaaaggcgatcagccgccggccgtcatattccggccagatgaacctgtcgccgtcgcgggccttcgcctcgtccagcagccgggtgccggcggcgaccatctggtcgaccacgcgggcggggaaggcgcgacgcatctccgccggatcgaagtaaaaattgcggtcgcccagatcgggcagcgtgcgcggccgccgctctcccaggctggtggtcactgtccgcagattgatcgcgggatgcgccggcgtaccctcgatgccgccgggtccgccggcccagagatccgagaagatcagcggccggccgccctgcccctccacatgcgccgcggcgtcgatcgtgtcggtcagccagtccgagagcggcggaaaaccgggcttcgccccatccggcgccgagccggggcagaggccgtaatccagcgtcggcaacaggcggtacaaccgccagatcgcgatcccggcgctggcgatcagcgtcaggaacagggcgagcaagccgcccgccagccagccggcccagccatgggcgaaccagatcagcagcagccccggcagcagggcgatcagattccagggcagacccgcacggatcagcagcggcagcgcggccatcgggcggcgctgcagccccgcagtcaggatcagctcgaacagatcccgcgcccgtggatcgggctggaacagatccagcagccgggtctgcaatgtgtcagggatggcgcccagggtctcgaagccgccggatgcacggccgtattccgccgcggccgtgatcgaggccgcgatcgcgccggccgaggtcccgccgacactgcgaaaacggtacatcgtcgccagttggaggatcgccttggggtaaacgacgccggaggtgatcccccctttcatgatcacgtcacaggtcagctctggatccgggcgggctgtcatcggcagggaggctccggtcatgacgcgtaatgcaacagactatcccatagatggatttattccgccagactctgggaggtttcggttgcacgctctgcggcctcttcggtgatccattccctgaaggcgcgaatacgcggatgggtgctgagggcatctgtggtgatcagccaataggccgcgccagtacgcagggccggcaagaccggcgccaccctcttcagccggccggccaccagatcggggcgggcgaaggcttcgggcaccagggcgatgcccagccccgccaccgccgccgccaggatcatgaagaagtgctcgaagcgcggctccgcccgccggcccgccgcaccatcggccccggccccctgcggcgagggccggaagccctgcggcggcaggcccgcagccccggcccagtcgggccagagatcggcccgggtggtgtggcggatgagcggcggcccctcgcggcccagccgtgccggatcgtcgggcagggcaaggccgggggcggtgaccggtatgacccgttcgtcgaacaggcgccgggcggcgaagccgcgccagccgccccgcccccagctgatcaccgcatccaccgcctctccatcccaggtgacggcatccttgcggccgtcggcgaaatcggccccgatggtcgacagatcgatcgcaaccgccggatgacgggcggcgaaccccgccagccgcggcgccagccatgccgcggcaaaggtcggcagggtgccgagcctgagcgtgcccgccacctcgtccggcccggccgcacccagcattgccaccgccgcttccagccggtccgatgccgcccggatcgccggcagcagggcggcaccctgggggctgagccgcagccggcggccgtcgcgcaggaaaatcggcacgcccagcgccgcctcgaccgccgcgatccgccggctcatcacgctctggcccaggccgagttcacggccggcggcggtcaggttcatatgccggcaggccgcctcgatcacggcgagttcggcggcgagcaggcgggcggcggcatcggtggccaagggggtgcctttcatgcaccagaagcatcagcatatgataaccggcaccgtttgatccgccagcgccatgagagatgatggcagccgaggacgactgcacatccgcgcagagagactccgcgccaaacagacatgggaacacgcgccatgaccgccatccgccccttccacctcgccttcccggtgctcgacctggaagagacccgcagcttctatgtcggtgtgctcggctgcggcaccggccgtgaggacgtgcactgggtcgatttcgatctttatggtcatcaggtggtggcccatctggatccgaatctggatcgcgccatcgccgcccgcaatccggtcgatggcgacgacgtgcccgtgccgcatttcggcgtggtgctgaccatggatcagtggcgggccctggcggcgcgcctggaggccaatgagggcacgcgctgggtgatccgcccgcgcatccggttcgagggtcagccgggggaacaggccactctgttcatcctcgacccctccggcaatgcgctggagttcaaggccttcaacgacgatgcgcagctgtttgcgacgacctgacagcagtttaccgggacctgcagcgcggccgaccggtcatccggacgccggacggccacctgcggcgatcccttcagcatgtggttttgttctgctgtactgatattatgagtgctatccacctgggtatgcgataaactcagacgatggtaatttttcattagacacgagttaacaatggctgacaccccctacgcgacgttgactccccccagtggctggagtgtctatagcaaccagggcgcagaaagcggcctgaaaacgaccgtatcgctcagctctggagagattgtcggcggagatccggccttcctcgacagcatcgccgatgcattttatgaggtcgccctcactgcggtcgaagcatacatcaccccctcaaacatcgaggatcctctgcagaattggggggattttctcacttctttgaagtccaacaccgttatccgtgatgcattggacagcattgccaatgtcaccgcagttcaggctgtccaggcggtcgccggtaataccgtgcagacctcgggttccgcgcttggtgagttgcaggacgaaaccctgcaagatgcaaccgatgcaatcttctccgaactgaacagcgggaatgtcgagccgggctctcttctcggttggtatcagtatacgatccacaccatcactcagcttctgacctcgaccactcttcaattccagaagtcggtcgtgggcaacgccgtcgaaatctatctgggtctcgacggacagatggtggcggcatcgaattcttcgtccatcacttacagcggcaacaattccgtggtcgtccagggcggcgctgcagacgatctgctgaccagcggcagccgcgacgatgtgctggtgggctgggccggcaatgacatcatgatcgccagtgagggcaaggacacctatattggcggcgatgggactgacactgtcgattacagcggttttcatggttttgcgaccccgctgaaggcaagcctggcgaccggcaagggcacctccggccccgccacggggcatagctatgtcggcgtcgaagtgctgattggtaccgctgggggggatgacctcactgccaacggcgcaggcaccacactctatggcggcgggggtaatgatgttctcagagacacgtcgaccactggcagtgccaccctcaatggcggggacggcaacgataccgccagctatttcgggagaacgcagggcataactgcctcgctgtcagcgccgggggacacgacgggttacctgatctccatcgagaacctgtatggcactgactataatgacgttctcgttggaaactctgaaaacaacattctgactggtttggaaggcaacgacacactggtcggccgtggtggtgccgacacgctggatggcaggggcggctcagacacggcttcctatcagagtgcttcatccagcgtgactgctgatttgagggcgggcaacgggacgcagggcgatgctgccggcgacacgttgatcagcattgagaacctcacgggcagcgcgtatggcgacaagctttacggtgactctgcggccaacgttctgcggggcggcaatggagacgatgccctgcggggacgcggcggtgccgatacgcttgacggtggtaacggcttcgacttcgcgtcctattccgatgcgacagcttcggtgacggtcgaccttgcttcaggcaaaggtcttgccggcgaagctctgggcgatacgcttgtttcgatcgaaggacttgccggcagcggctatgacgacctgctgcagggtgacggcaacgacaactacttctacggcaacggtggaaatgacattctgcgcggtcggggcggtgccgacaccttcgacggtgggagtggtcttgatttcgccacgtacagcgacgcatctgcgagtgtcgtggctgatcttgcaagcggcggcatctcgggtgaagccgaaggtgacgtttacatcagcatcgagggcctgacaggcacttcctatgcggacacgctgcatggcgacgcaggcagcaacacgcttgtgggtcgtgacggtgacgacattctcaacggccgtcggggggccgaccagcttatcggcggcgacggttttgacttcgctacctacagcgaggcctcggcagctgttgcggtggatctcgccagtcagagggggaccgctggtgaggccaaagacgacatcctcactgagatcgaaggtctgattggcagcgcctatggagatacgctctccggcaacaaggaggtgaaccacctccgcggtgaggccggtaatgacgttctcgacggacgtggtggtgccgatctccttcagggcggtgcaggcgcggatcaactcactggcgggaccggtgccgataacttcctgtacctgaacttgtcggatagcggcaagaccagcggtacttgggataccatcaccgacttcagccaaacagatggcgacaagattgacgtctccgctatagacgcctatgtgggatcgcccggcaatcagaccttcacctttattggcagtgccggttacagtggcacaccaggtgaactgcgggcgaatgtttcgaacggctatacctatatcggtgtggacgtcgacggagatcaggcgtctgacatggtcatacgcctgaatgggatccatacccttactgccgcagacttcattctttgacattgccctgctgaagagaaacggcccgtgcgcaggcgaccgcccaggcggcgcctgcgcaccagccggcgatgacgtcggtcggccagtggacgcccagatagatccggctgatcccgaccagaaaggtgagcccgatcgcgaccgccagcacatagctcttcagccgccgccggtcctcgaaccgtgcgagcagggcgccgagcgtgaggtaggtggtggccgacagcatggcatgggcggaggggaagctcgccgtctgcacctccaccagatgggcgaccagatccggccgcggccgctcgaagaccagtttcaggccgaagctcaacaccgtgccgccgatcaccgacagcgccacggtcagtgcggccgcacggctgcggcggatcagcagatagccgaccacgaccagggtcatcagccccagcaccgtggtgctgccaagcgcggtcaggtcggcgaagccggtttccagccagtgggggcccagcggatcggccgggtcggcggggttgcgcaggcttttgagcacggcgcgatccagcgcctcggtttccccctccatcacctcgtcggccagccagacgaagaacacgatcgccgccgtcaccaggcccagaggccaccagcggtcgatcagcttccgcctgccctcggccgcaccttcggacatgtttcctcccgcagttccatgatcggacacgcgaaaacgctaccggaagcggcaggccgcttccagtgagcgttccgggaggatggcgcggccgcgatcagcggccgctgcgcgtggtcgggtccagcaacatgcgcacgctgtcgcccagcccgttgaaggcgagcgccgtcaccaggatggcgaggcccggggtgaccatctgttcgggcgcaatctccatatagagataggctttggcgagcatcgagccccagctggcatccggcgcctgaacgcccagccccaggaaggagagcgaggcttcagccagcagcgcaccggccagaagcagggtcacctgcaccaggatcggctggatggcgttgggcagaatgtggcgggccaggatgcgcaccgggcttgccccgaaacagcgggcagcatcgacgaacaattcctctttcaccaccagcgcccgcgcacgggccaggcgcgcgatcagcggcgagaacacgatgccgaccgagatcatgccgttggtgaggccgacccccagcgcgccggtgacgccgatcgcaagcacgatggccggaaacgacagcagcgcgtcgatcacccggctgaccacctcgtcgacccagccgccggcgaagcccgcaagcaggccgatcggcaggccgatcaccagcgcgatcgagaccgagagcacgctggcatacatgctggccgaggcgccgtggatcagccggctgaacacgtcgcggcccagatcgtcggtgccgagccagttttcggccgaaggcggcatcaggatcaggtcgaaattctgctcgatcggcgaatagggtgccagctggtcggcgaagatgccggtgagcgcgatgatcgccaccaccagcaggctgagcgcgccacgcggatcgcgcagcatccaggcgagcacggggttgcgtcggcggggcgccgccccggtggcagaaggggttgcggtccggctcatcagcgtaccctcgggtcgaagacgacatagagcatgtcgatgatcaggttcagcccgaccacgaagacgatcatggtcagcaccaccccctgcaccaccggaaaatcgcgggcgagcgccgcgttgacgatcagattgcccacacccgggatggcgaacaccgtctcgaccacgacggtcgccgccagcaggcggttggccagcaggccgatcaccgtcagcaggttgaccgaaacgttcttgagcccgtgcttccagagcaccgcgccgccgggcaggcccttggcatggagcgtgcggacatattgcgagcccagaatatcgaccagcgaggtgcgcagctggcgcgccacctcggcgatgccgccggcggcaagcgcggtcgcaggcaggatcgcatgttccagcgcccggatcggatcatccgaaaaggcgaccgccccggtcgccggcagccagccgagcgagagggcgaaggtcgcgaccaggatcatcgccagccagaaattcggaatggcgatgccgaccgaggccagccccatcaccgcgccgtcgatgatcgaattgggccggagcgccgccaggatgccgagcggaatgccgatcaccatcgagatcagcatcgccagcaccacgatcagcaaggtcagcggaaaggtgcgggagagcgaggtcatcacctcctcgcccgaaatcagcgaccgggcgaggtcgccatgaaccgccccccacagccagtcgaaatactgaaccaggaagggacgatcgagaccgtagagtgcccggatttcggcaaggcgttgatcgctggcattgtcgccggccagcgtcaccgcgatgtcgccggggatcagctggatcagcccgaacaccacgaaggtcacgatcaggatcaccggcaccacctggatcaggcggcggcgcacggtgcggatcgcgcggcggctggacatcggatcggaagtcctcgaactggggagggaagccggaaagcggaccgggtggagcctggctccacccggcgacgggcaggcctcaggccagcgacacgtcgtaaagcttgggcttgttcagcaggttgggcttgtagccctccaccttctcacccgccacgtccagcgccgacaggaaggcgagcgggcagaccagggcgttgtcgagcaccagcttctggaccttcgagaaggccaccttacgcgcctccttgtcgggcgaggcacggctggcggcgatcgcctgcaccagctcgtcgggcaccgggccgcggccgccattgtaataggcgtcgggcaggtacatcagcgagaaggtcaggctgggatcgggccggccggtccaggccgagaccagggcgtcggtcttcttttcgttgccgaagaaggcggccgaggcctcgggaatggtgccgatcgaatagcgcacccggatgccgacctggcgcagctgctccatgatgaattcctgccgctgcaccgaactctggtcgggatagccacccagatgcagatccagcccgtcggcatagcccgcctcggcgagcagcgccttggccttctcgggatcataggggtagtagccggccagctccctgtcgaaggcccaatgggcagacggcaggttggtgatcgccttctcgccgatgccgttcatcgtcaccttgacgaaagcgtctcggtcgatggcgtggttgatcgcctgccggacgcggagatcgtccagtggcttgcgcgcccagttgaaatagatctggatgcaatagagcgtcgggccggtaaaggtggtcagcttcggcgcccgcttcgcgatcagcccctgctggggcgacaggaaatagacgaagtggttctgcccggccatcaccgagcgcagcccggtggagagttccggaatgatcgcgaattcgatgccgtcgaccttgggcgtgccctttttccaatagccctcgttgcgcttcaccaccaccttttcgttgtcgttccaggcaacgaagctccaggcgccggtgccgacggggttgcggtcatgggcatcgcccttctccgtcaccgccttgggcgagcacatcatgccggcgcggtccgacaggatcatcggcagggcggcatcggggttcttcagccggatggtgacctgatgcggcccgctcacctccaccgcctcgacattgatcaggtcggccttgatgttggagcgctgatccccgcgattgcggtccaggttgaacttcaccgcctcggcattgaaatcggtgccgtcgtggaatttcaccccctcctgcagatccatcaccagggtcttggggtcggggaagctccaggcgcgcgccaggccgggcttggggtccaggctttcatattcccattccaccagtgtgtcgaagacggtgtagaggaagggatggtcctggcccgagccaccggtcatcgggtccaggctcgacgggttggcgggcgccgccaccttcagcacgccgcccgcggccagcgcccggcggacatggccgggcagcatgcccgatgccgcggcgccggccgcaccggcgcccagcagcgacaggaaacggcggcggtccatcgcgaaggccgggcggcccccgacggtgaccggctcgcccgcggagatgttcaacggatccttggtcattctggtcttcctccctggtggccgccgccggatcttctgtcgcggtcgaccgtgccgcctgatgcggtcattctggttgggtccggtcttcgtcagccgggcgccagctcctcggcgaagtggcaggcgacgaaatggtcgggggcgacggggcgccagtcgggcacccgctcggcgcaagtcgcctgcgcatgggggcagcgggtgcggaagcggcagcccgaaggcgggttcagcggcgacgggatctcaccctccagcaggatccggcgcttctggcgcagatgggacggcagcggcaccggctcggccgacatcagcgcccgggtataggggtgcatcggccgttcggccacggccgccaccggccccagctccatgaaccggcccagatacatcaccgccacccggtcgctgatatgcgagaccacgccgatatcatgggtgatgaagacataggcgaggccgcgttcgcgctggatctcggcgaagaggttgagcacgtcgccgcggatcgacacatccagcgccgccaccacctcgtcgcagaccaccagtttcgggttgagcgtcagcgagcgggcgatgttgacccgctgtttctggccgcccgacagctcgtgcggatagcgccgcgcctgttccgcgctgatccccacccggtcgagcaggtcgagtgcgcggccggtccgcgacgcgcggtccccctcccccaccacgtccagcggctcgcggacgctgtcgagaatactcatccgcgggttcagggccgcgttcgggtcctggaagatgatctgcagctcgcggcgcttgtgccgcaggcggcggcccttcaaccgggcgatgtcgtcgccctcgtacaggatccggccgccggtcgggtcgagcaggcggacgatggcgcggccgagcgtcgacttgcccgatccgctttcgccgatcacgccgaaggtttcgcccgggcggacctcgaaactgatgccgtccaccgccttcaggctttcgccgtcggcggtggtgaaggtgacgcgcagatcctcgaccgacagcatcggctggtcttcggtcgtggcggctgcctgtcgaggggcgggcttcacggtgatcatccgacggtgccctccagctggagttccccggtgcgccggcagcgggcgcggtgccccggctcgggctcacgcatggcctgtgccgtggtgcaggcctcctcggcatggggacagcgggggcggaaacggcaaccctcgggcattgccatcaggggcggcacccggccggggatggagggcagcggcgcgccgcgctccaccagccgcggcagggcggaaaacagcccggcggtataggggtggcggggccggaccagcgcgtcgtcgacggtggcatcctcgaccacttcgcccgcatacatcgtcaccatccgggtgcaggtctcggcgaccacccccagatcatgggtgatgaacagtagcgccgtgccggtggtttcgctgaggtcgaccagcagatcgatgatctgggcctggatggtgacatccagcgccgtggtcggctcgtcggcgatcaacaatttcgggttgcaggccagcgcgatggcgatcatcgcccgctggcgcatgccgcccgacagctggtgaggatattcccccgcccgccgcgccggcagcgggatcccgacccgcgccagcaggtcgaccgcgcgttccttcgcctcgcgccgcgacaccgcctcatgcgccagaatggtctcgacgatctgctcgccgatggtgaaaaccgggtcgagcgcgctcatcggttcctgaaagatcatggcgatgccggcgccgcgcacccggcgcagctcccgccccgagagcttcagcaggtcgcggccctcgaagcggatcgcaccatcgatccgggcgaggccacgcggcagcagctgcatgatcgcaagcccggtcagcgtcttgccgcagccgctttcgcccacgataccgatccgctcggcggcccccaccttgaacgagacgtcacgggtcgccgagacgatcccgccgccggtgcgcaggttgatccccacacggtccagctccagcagcggcgtcgccgccgtcatcggcccgtctccgcggccgcgcgcgcggcggcgagttcggccagaagggattgtttcagcttgtacttttcgatcttgttggttggcgtcaccggcagcgcctcgacgaagcgcacatggcgcggcgtcatgtagcgcggcatgaccgaggccgcgaagctgcgcagctccgcctcggtcatgctgcagccctcgaccagctggatgaagacggcgcagtcctcttcctcgccttcttccgccgggaccggcaacgcggcggtggcgcggatgtccggatgggtgttcagcagatcctccacctggtaggacgagacgttctcgccgcgcacccggaagaagccgcccatgcggtcgatgaagtaataaacgtcgtcttcggtccgccgcaccgcatcgccggtgtggaaccagaggttcgagaaggtcttgatggtggcgtccggcttgttgaaatagctcctcagcagcagatgcggaaagcgcggccggaaggccagctgcccggcctcatccggacccagcacgttatcgtctgcgtccagcaccgcggcctccagcagcggcgagggccgacccatgaagcccttggccagcggttcggcgccgtccaccaccatgatcccccgctggcgggcgatttccagcaccgccgcgcggtcatgcccgacccggaagtccgggcgcttggcctcggcctcgccgaactggtcgatcagggcgacgaagccgttgccgctttcggtctggccgaagcctgcggtcgagaacgggatgccgaaacgctgcgccacctcgtgatggcgcgccggcagcggctgcatatgcacccgcatcatggtgttgtcgcgatcatccgcccgcggctcggcgctcatcagccagggcaccatcacgtccagcagcacggcgttgctcgcccggtgggtgcgcacccggtcccagaacctcgtcgggctgaacttgtcccagagcgacacggcacagccggtccagcaggccttggcgaccaggaacatcgccccgccgacatgatagagcggcaggtcgcaatagatcgtgtccttcgccgtcagaaaggcgcggctgttgaaggtgtactggttgatccagcggaagggctgcaccacgcccttggccgggccggtggtgcccgaggtgtagatgatgttggcgatatcggcggccccgcgggtcaccggccggtggcggcgcggggtacgcatcagctcggccaggtcatgcaggccgggccgggccagaagcgccggcggcagcgcggctttcgccggatcatggtcgtgatccgagggcagcggccggtgcaccacgatattggccaggctcacctcgtccagcaccgccgcgaccgccggggccagatcggcatcggtgatcagcacccgcggtgcggtgtcgttcagctgataggccagcagccggccggcatagttgaaattgaccggcgcataaacggcgcccgcctcccagaccgcgaacatggcaagggtggcgatccaggaattgcgggtgaagaccgacacgcggtcgtcgggttccagccccatctcctgcagggcggcggcaagggtcgccacctcggcctcgaaggcggcgaaactgaggtcgcggccctcctcgccatagcggatgaaggtttggtcaggatgatggcgcacggcatcgcggaagcggtcggtgaccacatccccctgctgcaccatcatcgcgaacagcgcctgggcgttcacggtggcagtcctcccgtcgcggccgtctgtcgcggccttgtatcgatccgtctgttccgggtctgccgtccggccggggatgaccggcggtcagttagaacaaacgttcgacctaggcttgattgttgaggagatggagggctgcgtcaataacgcgatctgtatcaccaccgcggtggcttcaatgccatggcatgcaggccgatcagtcggcgacatccgcgacccgataaccccgccggattccgggccgccggcagggcagattgtccagggcgatgcaatcgtccagcatctcgaccagcccgtcagggcagacccgcatttcgacctgatagagggcggcggcatgcagcaggcagccggcgatcatccagtcgccgccggcggtgcggccatggaccgtcagcggcttcagcacctgcgccagacgatcgcccagcgcgggcgtcacggcggtgaagggcagatcggtcaggcgctccaccaccaggaaaccgccatgatcgccgcagaccacggcacagaaccagcgcagatagtccatcacctgttcgggcccgtcgagcaaaggcggatcggcggcattcagcgcatgaacaacgcgcgaggtgccgtcgacatggcccagccggtcgggcagcatccccagaagcagggtcgcgaaccggccgtcggggcggcggaccagcaattccgccagttccagtcgggcatggaagatcggccggcacagccggacattcagcaggtcgggaaccagcggtcccagccccgcggccagcgccgtgcgcatcacccgggcggcgcaggccggcagtcgcgcctgccagacgccgatgccgaccggcggcagaggccagggtcgcgccgggtcgcaggcaagccggcccgtgatcgcctcgtccgcaattgcggcttcggcgaccgggtcacgccggatcagcggctcggccgtcacgaccatgggccgggatctccgtcagggggctccgctgccatagcgtgacacgaccggccaccgcatgccacagctcttgcgtgcggggacacgacggccgggcgtcgccgggttatgatatcccccgaaacccaatctcaggtttatggatgtgctgcatgctttctgcgcccatcacgcccgtcatcgaccccgccattcacgccctgcgtccggatttccgggccgtcagcctgaccgtcaccctcgcaggcccggcggtggccgatgcggatgcgatcgtggccgaaaccctggcccgggccatcggccaggtgcaggccggcggacccgactgggcagtggcgcatctcgacgactggcgtgcggccttccgggccttcggcgccaaacccgcccgcaccccgtcatcggcggaagccctgcgcaagcgcgtcatccgtgacggcgccctgccaccggccgggctggcggtcgatctctataacgccgtcagcctggccttcgccatccccgtgggcggcgaggatctggaggcctatcagggcgccccccgcctgatccgcgccaccggcaccgaagccttcgatgtgatgaaagacggcacgcccgcgatcgaaacaccggagcccggcgaggtggtctggtgcgacgacgccggcgtcacctgccggcgctggaactggcgccaggggctgcgcacccgcctgaccgcagattcgcgtcggctctggttcatcctggaggccctgggcagcatgcccgacaccgcgctggcggcggcgggcgcggcattggccgacggcctgatgcgtatctggccctcgtcaataatcgtgcggcatgaccttgatccgcgaaactgagatatggcgccaaatgcagtgcctgttgtagacttatgccaggcgttttcgccctcaactttaaagtacgacaggccacacgccatgcagcagaatcacccggtctccggcgccgagacatccgacaccaacgcaatgcatcgcaccgtctggcagcgcccgcagctgcagaccgacgacgtatcgttgtccaccatgttcaatatagccaccaatggcaccgacagtgtttaccaaatctcctgatgtccggcgtatcataaccggcaagcctgcctcccgacgccgatcctgctacacgaaagacatcatatcatgcagctgacccacccggtctccgacaccacaaaaagcccgcgccgtctggcccgcgcggtctggcgccgcccgcagctgatgatcgacgacaccgcgtcgtcaacgcacgctttctccgcgttcaccgaggacggcggcctgcaggtgtcctgacgatcaggcccgtccgtcgatcagacccgtccgccggctccgcggacgggaaccttcacatgggcaaccgcccgccgcggcggcaggaagatctgcggaatgcggatgcgccggccgcccgagccgtcatgatcatcgccggcctggaaccagaccgcgaaggcgacctgaacgctccccagcgtcagccccatgaagaaggtgagcaccgccgccgccagcgggccgtcggcattgccgctcatcaacgtgcccaggcccgagacgtcgaaccagagcagggcgccgaccacggcgaaggcgagaccgaagcccaccagggcgtgcatgacgacaaaacggaccagcatgggcatcggacgggcgctccccttcggcgcggtgacgcatcttccatgactatggccccgccctggcgggggtcaagatgccggaaggtcgcaggcgcgcgcggtgcccgccgccgccatcccccggtgccccggccagcagccagagcgcgaaggcgatctgcaccacggcgagcgtctgccccatcaacagggtgaagaccgcccccgcaagcagcccgccccgcacctccagaaccagcccgcgcagccccgagacatccccggcgaacagtgcggcaacaacgcccagcgccagcacatagcccgccgcggcatgggcgatcagaaaccgcggcaggcgcccttcggccattccatccatgacaacagccttccgtcgggggcagccggaaaacccggcgcctttcccgacgcaacgcggtgctgcccggcgtgttccgcctcagacctccgcggagggccgatcctccagcagccgtttcgggtgcatgccgtccaccatgcccatgaagggcgcgtggatcgaataacccagcatccgccggatgtgttcgctgcactgcttcaccaccggaagcggcaccgacaggctgaaattttcctgctggcggcaccagggcgcgcagtactgggcggtgagcgccaggcgcgcgccgtcgctgcgattggcaccgccgctgtgccagagcgtgcccagaaacagcaccaccgatcccgccggcatcaccacggggaccgccccttccgcctcttcaggcgtgggcaggcggttgccccagcgatggctgccggggatcacgcgcgtcgcaccgttcagcggcgtgaaatcatccagcgccatgatcgtcgccgcccccagcaccggccgcggccggggcaggctgtagaagctgtcgtcgaaatgcagcgcctgcgcctcttccccgggcaggatgtcgatcacctgcagctgcgagagcagataattgggctcgaacacccggtcgagcagggccagcaccagcggatgttcgaccagcgggttgcaggccaacgtcttggcgatcacggcataaagcctgcgggtcttcagcccctcgaacgggttgcggccgccgcgcggcgccatatgcggcagcaccgccgcccgcatccgggccacctcgccgggtgcgaacagattttccaggatgacatagccgtcgcgctccagcgccgcccaggcatcctccacccgcgcgagcggcgccgtctcctggctgccggcggtggagtggtatttgcgcggggaaccggtgctggcatagtcgtcgaggccgtcgagcatcagcggggccatgggcgggtctcctcctccggttgcgacatccatgccgtcttggcccttaaggatgatcctgcccgccctcgggaacaatgacgcggcgtctcacacgacatgaccgaaaacccgaccgtccttcgccgttggatcacgcccaccatcccggtccgcttcgcgcgggagctgaccgaccgcctgccgctggcacccgaaatcctgcgccgcatccaccggcgggccggcatcgacccgcgcctgctggaggccgacgggccgcgcatcgcccccctggcctatcgccggctgcaacgcctggcggtcggcgcggcgggcgacgagttcctgggccatctggcccgaccggtgcccccgggcatgacggccgaactgctcaggctgatggcgcatctgccctcgaccggccatgccatcgatgccgccggacgcatgatccgggttttcgatggcgccctgccctggcggatcgatcaggccgacggtcccgccggcccggtgcgactgcagctgacgccgcgcaccgccgcccagggtgatgccctgctgatgccgcatctgatcctgctcgggctgatccatgtcatcggctggctggcgggggaggccccgccgctgcggcgggtcatgctgcccgagcgctttgccgccctggccgcagagtccacctttctgttcggccggccggtggagcatggcgcgacgcccggcgggctcgaattcgccccgggcagcttcgccctgccggtcaccgcccgccccgaccgcgccggcgccttcacccgccggctggtggagctgatgaccgcccccacagccccggccggcaccgaagccgccctccgccacctgctggcggccacccgccccttcgccgggctcagcgagacggtggcggcccgggcgctcggcatgtcgcgggcgacgctcgcgcgccggcttgcatcttccggcatgtcctttcgcgggatccgcgacgagctgcgccgcgatctggcctgcagcctgttgaggcgcaccgaactttcgctcgcggacatcgccgaccggctcgacttctcggaacccagcgcgttccagcgcgccttccgccagtggaccggccagcctccggcgcgctggcggcggctgaaccgctgatgcacgatcggccaagttcggcttttcgcactttcgttcctggctatatgatgactgaaacgaaagccgggggcccaagggaccgccggaaacccgcagtcgaggacgcgccgccgatgtacctgtctccccgccatgccgaaatcgtccagcttgccaaggacaagggccggattctggtcgacgaactggcgacgcatttcggggtgacgccacagaccatccgcaaggatctgaacgacctctgcgagcgccggctgctgacccgcatccatggcggcgcgctgttcccgtccggcgtgcagaacatggaatacgaggcgcgcagcctgatcgcgtctgacgagaaaaccgcgatcggccgcgccgccgcccagctgatcggcgacaacacctcgctgttcatcaatatcggcaccaccaccgaagcggtcggccgcgcgctcaccgatcatgccgggctgatggtcatcaccaacaacatcaacgtcgccaaccggatgcggatctacccctcgatcgaggtgatcatcgcgggcggcgtggtccgcggctcggatggcggcgtggtgggcgaggcggccgtcgatttcatccgccagttccgggtcgattttgccgtgatcggcgtgtcggcaatcgacaatgacggcgcgctgctcgatttcgatttccgcgaggtgaaggtggctcaggcgatcatcgccaatgcccgtcatgtgatcctggtcgccgattcgaccaagttcgaacggaccgccccggtgcgcatcggccacctgtcgcaggtcaacaccttcatcaccaaccgctgcgacctgccccagatccgacggatctgcgccgatgccaatgtccggctgatcgagaccgatgcacaggcgagcctgatctgacgtcagactggtcgggtctcagacaaaagacaccgagagctggccgaaggccctccagtccgctgcgacacggtcgcccggctcgaccgcgatcggtactacgcaggtgccggtgatcaccacctgacccgccctcaacggcaggcccagggccgagacctcgttggcaagccaggtgagcgcgaggcgcggatcgcccagcacattggcgcccagcccgtcatgacggctgcggatccggccatccggaccggtgaccacggccgagggcgtctcggcggcgaggtcgacctcgcgccagggcgcggtcgtggccgggcccaggatgaacaggttggcgcaggcatcatcggcgatcagctgggccgcacccacagcgcagaaatcctcgtagcgcgaatccggcagctcgatcgccggatgcaggctcgccaccgccgccaccacctcgtcgacggtgaaaggctcgggccgcggcgccagatcgcggccgaagcggaaggcgaattccacctcggccacacgcatcagactggtggcgagcggcaccaccaccccatcgggcagcagacgctctgcgaacaatcggccggccagcggaccgtcgacgccgatatggcgctgaccggccaggctggtggcggcgatcttccagccgatatgggcagccggatcggccaccagccgcgcctggatggcatagccctcggcccggctctgtggctgcagcgcagcgggcaggcaggcgagccgcgtgccggcattccaatggtcgatcagcaaccgggcagcggcagcatgtcccgacatggcgatctggttcatcggcggatcctccctggtacgttctcattttgcggaacttagggaagatcatgccatgagccgtatcggatacgtcatatggaatgtgcagctgccggccatggcaggcaggtgatcagcgcgcccgcacggccagcgcggccgccaggccgagcaggccggccgcgaagatgaaggtcgcggcatggccgcccgcatcgaacagcacgccgcctgcagcagccccgaccgtgatgcccgcctggatgatcgcgaccatcagcccgccgccggcctcggcatcctctggcagggtacgggcaagccaggtccaccagccgaccggggcggcggtgccgaccaggccccagaggccgagcagcggcgccacgatccacagccggtcacccgcgaccgcaagtccgagggcgatcccgcccaggatcaacggcatgccgatcagggccgcgccgaggctgcgggtcagcaccattccgatcaggcttgtgccgatcagcccggagatgccgatcaccagcagaagcgccgagagcgtatcgacatccacccgcgtcacggcctccaggaaaggccgcagataggtgaacagggcgaactgacccatgaacaggaacagcactgccgccatgcccgaagcgaccgggcgccgctggaaaagacgaaaggggcttctgcctgcccggcgaccgccgggcatgcgcggcaggctgcatgcctgccagacgaaggcgattgcggcgagcggcacgatgcagaagaaggcaccgcgccagccgatcaccccgcccagaaagctgccgagcggtgccgcgatcgtggtggccagcgcattgccgccattgagcagcgccagcgcccgcggcacggcgtgatccggtaccagccgcatcaccaccgcggtggtcatcgaccagaacccgccgatcaccactccgagcagtgcccggccggccatcagcaccgctccatcgggtgccgcggccacgatgatgcccgagatcagcatcagcccggtcagggcgagcagcacggtccggcgatcgacaccaccggccagacggctgatcgacaggctggtgagcacggcaaagacgcccgacacggcgatcgcctgcccggcccggccttcggtgatggccagatccgccgcgatcggggtcagcaggctgaccggcatgaattccgaggcgatcagcacgaagacgcacagcgacatcgcgaacacgccgccccatgccgcggcagtgcgaccgcccgacgctgcggatcggatgtccaccttcacggcaccccctgcaccgagaggggaaaactgccgcgcgtcagcagcggcccgatgccgccatccagccggccgagacggatcaggccccgcgaataccggtagcctttgtagaagaaagcgagattgccccagggtgcgaaatagcagaggtcgcccggcgcctcgcccgaaaacgtgccgctcccgtcctctgtcagccggcgcggcaggcgggcgatcttctcgttggtggaatagtcctcgatcgtcagatcgagcggcagcatcgacatcagatcccgcgccgtcggtgtatcgtcgagggtcgccgtgaagtcatgagtgtcgaaggtgaaacgcagctgcatggtcgtgcccccgcctggagttgcggcacggagcggtactggcgtcatggcagcagccgccgcctggagcagcaacccgcgccgtgtgatggagaggcccatgcccctgtcctcctgatcgctccggatggaaggtcctgaggctagcagctgccgcccatggtcattagccggtagaatccgcatcttgttatgaggacagttcatgaattgcctgcagcccgacctgcgcaggcaatgctatgaagaccgggacaccaccagcgggggacatagatgccgcgcgacaatctcaatgacctgcaggctttcctggcggtcgcccgcgagcgcagcttcacccgtgccgcagcgaaagccggcgtctcgcaatcggcgttgagccataccatccggcagctggaggcccggctgggcgtgcggctgctgacccgcaccacccgcgccgtgtccctgaccgaggccgggcagcgcctgctcgacgggctgggtccccatttcgacggtatcgaggccgaactcgatgcgctgaacgcgctccgcgacaagcctgccggcaacatccggatcgtcgcctcggatcacgcgctcaaccatctgctctggccgaagctgcgccggttcctgatcgagcatccggacatcaaggtcgaactcgtgctcgacaacggcctcaccgacatcgtcaccgaacgcttcgatgccggggtccggatgggcgaacagctggccaaagacatgatctcggcccggatcggtccggatttccgctttgccgtggtcggcgcacccggctatttcgagacccgtccggtgccgcaacatccgcgggaccttgtcgagcatgtctgcatcaatcagcgcatgccgacctcgggcgggttctgggtctgggattttgaggaagacggtcgtgagctgaagatccgggtcgacgggcagctcgccttcaacaacatttataacgtcgtcgatgcggcactcgacggcttcggtctcgcctatgcgccggaagacatcatcctgcctcatgtcgaggcgggacgtctcgtgcgcgtgctgcaggacttctcgcccgactgggacggctaccacctctattatccaagccgccggcagtcctctcccgccttcgtcgccctggtcgaggccctgcgtcaccggagctgaccggccggatcaaccggtccggctgcggcgcggtggcagggccgcagcggcggcggcctcgtcgccgatgcccggcccggcgcgcacctccacctcgcgggcacgcagttcctcgccacaagccctgcaggtcagcaccggttcgatgtcgtggccgcaattgcggtgacgatgcagcatcggcggcccggcctcgcccgcatagtgctgattaccccagtgcacgatgctcatcaccaccggatagagatcgaagcccttgggggtgaggcggtattcgtcgcgcggcggccggtcctgatagcgcacccgcgccagcacgccctcatccaccagcagcttcagccggtcggcgatgatggtgcgcgaaatgcccagccgctcctgaaaggcgtcaaagcggcgcacccccagaaagcagtccctgagcagcatcagggtccatcggtcgccgatcaccgcaacggtgcgcgccatggaacagggctggtctttcagatcatcgcgtttcatggctgcagtattccattgactcgatccagattcaatacgaacttcgtccagaaactggacttacataatcccgggcaatatgatgacccggtcgggaggaggaacacgccatgagccatccaacgacgcaggccgaacccggcggcacgcccggcgcctgcctggtcatcggcgccggcatcggggtcggcggggcgatcgcccgggcgttcgccgcccgcggccacgcggtctgcctgacccgccggccgcgcaatctggaccaggtggaggcgctggccgaggagatccgcgccgagggcggccgcgcccatgcctatggggtcgatgcccggtcggaagacgagatggtcgccctcttcgaccgggtggaggccgaggtcgggccgctggaggtggtggtcttcaacatcggcgcgaatgtccgtttcgacatccgcgacaccaccgcccgcgtcttcaccaaggtctgggagatggcctgtttcgccggctttctggccgggcgggaggccgcgcgcgtgatggtgccgcgcggccggggcaccatcctgttcaccggtgccaccgccagcatccgcggtcgggaaggcttcgccgcttttgccgccgccaagcacggcctcagggccgtggctcagagcatggcgcgggagctggggccgcagggcatccatgtcgcccatatcgtggtcgacggcgcgatcgacggcgccttcacccgctccacccgcgaggatgttcagacgctgctggaccaggacctgatcctgaagcccgaggacatcgccgccaattatgtctggctgcataagcagcccaaatcggcctggacgcatgaactggatctgcgcccctggtcggaaacctggtgagggagaccagacgcatgagcagccgcaccgtcgacatgatctatgatttcggcagccccaacgcctatctggcgcgccgggtgctgaaccggatagccgcccgcaccggcgccaccatcaatgtcattccctgcctgctgggcggcatcttcaaggcgaccggcaatcaggcgccgatgcaggccttcgccggcatcaagggcaagaacgagtacgaggcgctggaactgcgccgttttgtagccaggcacggcttcgatgccttccggatcaacccgcatttcccggtcatcaccctgctcgccatgcgcggcttcatcgccgcgaagcgcatgggggtgggcgacgcctatctcgatgccgtcgaggtcgcgatgtgggaaaccggccgcaagatggacgaccccgaggtcttcgtcgccacgctgaatgaagccggcctcgacggagccgccatcgccgccgcaacccaggacgcggcggtgaaggccgaactcgccgccaacaccgaggcggcggtcgcccgcggcgccttcggcatcccgaccttctatgtcggcgacgagatgttcttcggcaaggaacggctgggtcaggtggaagaggaactggcgaaggggtgagcctccgtcagcgccggttccgggcgatcacctctgtggccgtcaatggctggcaggccatgtttggggcggcgaaggcttcggtcagcgccgccttcagacggtcgaaagcccccttctcatccccggcccgcttctcctcccccgtctttggcggttgatcgacgtctgtggtccgcccgttgatccgggacatggcgaaactcctcggccggtccgcatcaattcatggtgcaggtgacgcggatgatatcgcctcttcatccgcctttcacctgtcacttggctcgcccctgccggaacgcctgcggcgacaggccataggcgtcgcggaagcggcggccgaaatggccggcgttctggaaaccccacgagaaggcgatgtcggtgatggtgcgtcccgccatcaccggattggccagatcgcggcggcagcggtccagccgggccgcgatcagatggccacggacggtggtgccgtcgccggcgaacagggcatggagatggcgaagcgagatgccggccgcggccgcgatcccggccggatccagatcgggatcgtcgagccgggccgcgatcaatgccttcacccggcggagctgcgccgcccgcaacccgtcggtgcggcgcggggtctcggcacccaggcctgcgaccagcacgcccagcatcgcctcgcccagcgcctcaccatcgggcaggttctgctccagcagcccgccggccatggcgcccacagcgccggagaccatcgccgcccccgccgtgcctgccgccatgcggccggtcgccgcctgccagctgcccggcagccagtggcggagccgggaaagcggcagcaccaccgaccgcttgtgcagacgttccgtcacctcgaagctcatcggccgggtggtggtccagaccagcacgtcgccggggccgagggcgatacgcgcctcgccgatcgagaactgctcacgaccgccgagaaccagctggatgacgacaagctcgcggccatcacgcgcaggccccggccggcggcggctgccggcacaggggtcgcagatacagtcgacgaccgtcaccgggccgacggtccgctgacgcagccgcgcgtcgaagcccggcatcggccggccggtggccgcccagccgtcatagacggcttcgagcgtggtgcgccagacctccgggcggaggtccggcgggtggtcggcggcgcgccaggatgcgccgcccggcgcggtggacaggggtgtggtggacaggggcatgggcgactggcctccccgcctcgctggcggatatgtcagccgtggaagggggtgaacgtctgaaccaggatccgatcgtcgcggaccagcagcgtgtcggtcgcccgcgtgacgaagggcgccgccgaccagaccagataggcgacctcccccgccacctgacgtgtctcgacccggaaggccgcccagaattcgggcgtggcctccgcaaggaagccggcaaagaactgccggatctcctcggtcccatgatgcactgcatccggggtgatcaccactgccgccgcatcgtagtcggccagaaccgcatccaggccctgtgcgaaggcgccgagatggcggtcgaacacggcggccgtgctcatgactgcgccgaaaggaaggcggtccaggccccctgggcctcggcccagccgatattggcgatcaccgtgccgtccggctgaatgaaggcgagcgggccgaggaacgtcatatagaacacgctgtcgaccgggaagaaggtgcggtcgtggcgggcacccgaggattcgaagccatagcccggcgcaaccgcggtgtcgccgccggcatcccggccgccgcgcacgtccatgcggccatgggtcaggaaatactcgcccggcccggtatggatatgggccgcaaaggacgatccggccgggcaggtgaaaatcgcggtccagccgccgctttcgggggaaacatgcagcagcttccaggtgatgccgccgtcggagaaggcatcggggaacggtgcccagggcccgtcgtcgatctggacatattcctcgggcgtctgcggcttggcgatatggctcgtcgacatcagcatgatcgtcctcccaggtctccgttgaacgccccgtctgcggggccgcctcttgcgggcctgatcagtctggcagggggatcgggccgccgctcgcctgcgggtgcacgtcgtcgggtctctcagcgcgcagcgtcgccgcgcgccacctcgacaggcgacaggcacgccgcctgccgctaggctctgccccgatgcccacccctggggccggctgccatcggcccccgccactcaaggagacggtcatgaccggaaccgccgccgccgatccggccacccgcgatttcatcctcagccagaccatgctccggatccgcgatccggaacggtcggtcgccttctatcgcgacgtgctgggcatgcgcctgctcaggcgcttcgacttccccgagatgaagttctcgctctacttcatgggctatgtcgacgcctcggacgagccacagcccgagaccccggccgaggccgccgcctgggtgttccgccgcaagggcgcgctggagctgacccacaactgggggacggaaagcgacgaggcctttgccggatatcacaacggcaacagcgatccgcgcggcttcggccatatcggcatcaccgtgcccgatgtctatgccgcctgcgcgcgcttcgaggagttgggcgtcgatttcgtcaagcggcccgatgatggcaagatgaaggggctggccttcatccgcgaccccgacggctactggatcgagatcctgtcggcggagggccttgccgggctggtgaccggcggctgatcccgatcaggccggatccggaccggcggttcggcggttgccgtggatttcgtataccaagtacaatcctccggccccgcccttccgccgctccggaccccagcctcatgacagccggcctcatgacccagatcagcgacatcccgcgcctcggcgaacagcatctgccgctgcatgaacgcgtacgtgccgagatccgaaaggcgatcctgaccggggagctgaaacccggggaccggctggtggaagaccgcctggcggaggtctacggtgtgtcgcgcaacccggtgcgcgaggcgatccgcgggctcgccaccgaagggctggtggaagtgctgccccgccgcggtgccttcgtcgcccgcatggcgcccgacgaggcacgcgaaaccatcgaggtccgcgccctgctggaaggccagacagcccgcctcgccgcccgccgccgcgaccccggcatggttcatcgcgcccgcgacatcctggcgcgcggtgatgcggccatggccgaggggcgggacgatctgcttgccggcctcaacatcgacttccacagggccctggccgaagccggccgcaacagcgtgctgtcggacctgatgatcggcctgcgcgaccgtaccgccgcgctcttcgccgacgacacccccgcccgccgccgggcggcctgggccgatcatgccgccatcctggaagccgtgatcgccggcgacgaagatctggctgcccagcgcgccaccgcccatgtgctcagggccggtgaggccttcctgggcgagggctgaggcgcggtgatggagaagacatgatgcaggatattgccggcgcgctgccgggctatgagagcttcgaccgcggcacctgggcggcgctgcgctccaacacgccgctcaccctgtcggaagccgagctggcgggcctccgcgggctgcaggatcccatcgggctcgccgacgtgtcggaggtctatctgccgctctcccggctgctgaacctgcatgtcggcgccgcacggggccttgcgcgggtgcgcgacgccttccttggccgccccgccgggcggcccccctatgtggtggcgctggtcggcagcgtcgcggtcggcaagagcaccttcgcccgggttctgcgtgccctgctcgcccgttggcccgatcatccccgcgtcgacctggtcaccaccgacggcttcctgcacccgaccgcggtgctcaaggcccgcgggctgatgacgcgcaagggcttccccgaaagctatgataccgcggcgatgatccgcttcctggccgcggtgaaagcgggggcggaagaggttgcggccccggtctattcccacctctcctacgacatcgtgcccggcgagttccagatggtccagcggcccgacatcctgattctggaggggctgaacctgctgcaggtggatggcaatgccccggcggtggtgtcggatttctgcgatatcgcgctctatctggacgccgacgaggccgatgtcgcgcgctggtatgtcgaccgcttcctgctgctgcagaagaccgcctttggcaacccggcctcgtatttccaccactatgccgatctgccccatgatgaggcggtcgaggtcgcccgcggcatctggaccggcatcaatcgggtgaacctgcacgagaacatcctgcccacccgcatgcgcgccgacgtcatcctgcacaaggacgcaacccatgcgatcgatcgtgtgctgctgaaatcgatctgacccgcccccggaccgcatcaaccatctggacataagggcgggaccggcgttcaatttcctcaaccaagacgcaccggcacgcatcggtgcgaccgggggaggaaaagggcgatggtattcgattatgtgatcgtgggcggcggatcggcagggtccgtgctcgcccgacggctgacggacgacccgtcggtcagcgtctgcctgatcgaggcgggcggcgagggccgcgaccggctgatccgcacgccggccggcgtggtggcgatgctgccggggcggccgaagatcaacaactgggcctatgagacggtgccgcagccgggcctggacggccggcgcggctatcagccacgcggcaaggcgctgggcgggtcgagcgcgatcaacgccatgctctatgtccgcggccatccgtcggattatgacggctgggcagcggcaggctgtccgggctggtcgtgggatgaggttctgccctggtttcgcaaggccgaggccaaccagcgcggcgcggatgatctgcatggggccgacgggcctcttcaggtctcggaccagccctcgccgcgcccggtctcgcgggccttcataaaagctgcggccgaatgccagttccccgtgaacgaggatttcaatggcccgcgccaggagggcgtcgggctctaccaggtcactcagttccacagcggcccggcgaagggtgagcgctgctcggcagcggcggcctatctgcatccggtgatggcggcgcgcccgaacctgcacgtcatgacccgcacccatgccacgcgcatcctgatcgaggacggccgcgccaccggcatcgcctggcgccgcggccgggagacaggtgaggtgcgcgcacgtgccgaggtgatcctctcgggcggcgccttcaactcgccccagctgctgatgctctcagggatagggcctgcggccgagctgtcggcgctcggcatcccggtggtggccgaccgtcccggcgtgggccgtaatcttcaggaccatcccgacttcatcctgggctggtcgtcgaccgacagcgacatgttcggcatcggcatggccggcaccggcagactgtttcgggcctggcgggagtggcagcgcaaccgcaccggcatgctcaccacccccttcgccgagggcggtgcctttctcaaaaccgatcccgcgctcgaccggcccgacattcagctgcatttcgtgatttcgatcgtcgacgaccacgcccgcaaactgcatgccggctatggcttcagctgccatgtctgcgtgctgcggccgaaatcccgcggcagtgtgcgcctggcctcggccgatccgctggccgcgcccgcgatcgacccggccttcttcgccgatccggacgatctggcggtgatgctgaagggcacgcgcatcacccggcggatcctctcggcaccggcacttgccccctatcgggcgcgcgaactctatctctcgggcgaacccgacgacgacaccctgaccagccacatccgtgcccgcgccgacaccatctaccatcccgtcggcacctgccggatgggcaatgacgaaggcgcggtggtgacgccggatctgcggctctgcggggtggatggcctgagggtggtggacgcttccgtgatgccctgcctgccgggcggcaataccaacgcccccaccatcatgatcgccgaacgggcggcatcgatgatccttgccgcccgtagcaccggcgcgaaggcggccgcctgaggcaaggaccggcctcagacgccgagctgtcgtttcagggcctggcggaatgccgcggcggccgggccgaagggttcatcgatccgatgggccagataggcctccgcggcaagctggctgtcacggccgagcgctctggtcgcgaggcgcacgagacgcccctccgccagatcccgcgccacctgccaatggggcagtcgcccccagccgaggccggccaggatcatcgcatgcttcgcgtcctggccggtgacgcggcaggtttgcggggagagaacgccgaacatgcggtcgccggtgaccggcgtggggtcggacaggacgatctgcaggtgatcagccagatccgcaaggccgatggacccgcccgattggcgcagcgccaacggatgcccggccgagacgacggcgacctggtcgacggacgagatcgcctcgaacgcaatccgcgggtcgcggaaatcctcacccaccacgatcgcgagcgcactgcgcttttcgatcagcgatgtcatcggtccgccaagcggctcgacggccagacggatggagaccgtcggatatgcggcacgcatcgccgccagggccgccccaccgcgtcgatcgggaacagggtgtcgacggtcagtgacagctcaagctcgaccccctctcccaggccgcgggctctggccttcagggcgtcgatcctgagaagaatgtcgcgcgcattcgagagcagagcctgcccttcagccgtcagcaccggccggtgaccggtccgatcgaagagggtcagccccagctcggcttccagattggcaatggcatggctgacggcggactggacccgcgacaggcgggcggccccggcccgaaagctgccgctttccgccacggtcacgaaaacccgcagctgatccagtgtcagcacatccagcatgatctatccgatcgatcgaacctatcaattctatatcacttctgcgtatcaaccatacgcctatccttccgtcggttcaggccacgaactgcggaggaaaggttatgaccagggttcttgtgctgtactactcgtcctatggccatgtcgagacgatggctgaggccgttgccgatggcgcgcgcgatgccggtgccgtggccgtgctcaagcgggttccggagcttgttccacagcatgtcgcggacgcggccggatacaggaccgatcagcgggcggatatagcgacggtggccgagcttccggagtatgacgcgatcatcctcggcacaccgacccgcttcggcaacatggcggcccagatgaagaacttcctcgaccaatgcggcggcctctggttcgcagacaggctggtgggcaaagtcgggagcgtcttcacctccaccggcagccagcatggcggacaggagagcacgatcctctccgttcacaccgttctgctgcatctgggcatggtcgtggtcgggctgccctattccttcaagggccagctgcggatggacgaaatcaccggcggctccccctatggggcatcgacgcttgccgatgacggcagcggcggggatcgccgccccagcgagaatgaactcaacggcgcccggtttcagggccaccatgtggccgggatcgcccgtgccctcgccgccgcacggaatagcggggcggcgtgatggcgtcgaccggatgcgcggcatcgccgcagggcagtcattggcctgccgtcggcgtcgtgctgggcgcgggcatcgtcacggcgtttcatgccggaaaggtcgccatcgccacgcccatgctgcagcgggatccgggcatcgaccttgcggccgccggctggctggccgggatcttcgccatcctcgggtgtctgggcggcatccccgccggttcgctggtcggtcgtgcgggcgatcggcgaagcctgatcgccggcctcgccctgaccgccctcggggccgtcatcggtgcgaccgcatcgggatatggcctcctgctcgtgtcccgcatcctcgaaggggcgggctttcttctgatcacggtggccggacccgccattctgaaccggatcgcccggcccgggcagcaggacatcgtgctcgccctgtggagctgcttcatgccggcgggcctggcgctcgccatgttcaccggccccctgccgggggactggcgtctgctctggtggggtggcgccggcctcggcgcggccctgatcctggcggcacgggcagtcattccgcccgcgccgacccgcgcgcgcccatcctggcggcccatgctgtcggatgcgctgcaggttgtgggaagcacgaagacgaggctggcggccagctgcttcgccctctacagcctgatgttctttgcgctgttcagctttcttccggtcctgctgatgacgcgcatgggcctgtcgcacagcacggccggatggctgagcgccctggccatgatcatgaacatcatcggcaatctcaccgccggctggctgctcatgcgcggcatcaggcgcgccgcgcttctgtccggcgcctgcctgatcatggggctgtcgtctcttggcatcttcctgccggtcttcgacgacatcccgaccgttctgctctgcctgctgtttgcaggcgtcggaggtctgatcccggccgcgctgatctcggcaggccccacgcttacgccatccgcaccgctgatgccgctcggcatcggtcttctgatgcagggcagcaatctgggtcagctggcggggccggtcgcggtcggcagtgccgtcgaggcctggggatggccggcggccgcgggcgtcgtcgcaggctccgccctgattgcaatcctgatcgcccggcgtatcggcgtcgatgacagccagcccgcccgcccggcgatgccggccgatcctggcgtcaggcgacggcgctctccgccgacgcctcgatctcctcgcaccagatcatgatcgtgttgcgatcatgggtggcaccgatcttcaccaccgccccggccggcagatcccgcggggcatcgaaggggaagaagcgcaccgcccagcacgaagaaagaccctgatccgggcggttctcgtagatcagctcgcccgtgccgtccatgtccatcttcagccactggaccacaccggcgacccggccgccggtggcggtcagcttcgccatcgcccggccgcccggataggggccgccggaacgcaggtcgaaatgcatcaggtcgtggacggcactgcggagcgtaaaccgggaggaatcggcccccacccgctggcagacctgggccagatggtcgaaaccgccaaggtcgaagcccgaaacttcgcccatgcggtgccttacggcgcgggtatcgtcgaccagcgccacccgggcggtgaccgaatccggaatcatccgcgccccgggcttcagcagccgcttgaccgcatcctccatcgccggcagcacggcctcgcccaggagatcgttggagatgatctcctgaaccagcagatcggcgcggccgtcgatatcctcgccgaccagcgcgtcgtcggatttcttgggcaccacggtcacgcgatcggcatagccgttcttcgcgatgatccgggtcgctgcctcggcgaccgacgggttcatctcgcaggtcgtaacccgttcggcgccagcccgagccgccatcatcgacaggatgcccgtgccggtgccgatttccagcacatgagagccagggcggaccagccgcttcagcgccgcctcgtagaggtcgttgcggcgctgatcgcggatgatcgaaaaatgccatttcggcacatcgcgggccagaatgtcccgcgccaccatcaccgcctcgggatgaccgtcgcccgccacctccagcacccgcagggcggcgacccgcgcctcctccttcttgcccttggaccagagcacgaccgcaagacgggcgagcggcaggggcttgtcgtgaagctgctgggcaagtgcgtcggcgctgatcggcatgaggcggtcccggaggtgaggatgtcgtcggccggcatcatgtcacgtccggaaccggagtgcgagagggtgtggcagcataagccgcgagggggcgctcagctcgcaaaccgctcggacttcaaccgcagtcccgccgcctcgcggtcccaggcatcggccgtgatgccctcggcgcggagttcgtgtttcagcaccttggcggtgggtgtcttgggcagggcgtcaagcacgcggacatagcgcgggatcatgaaataggccatgcgcgggcgcaggaactcgatcagcgccgccgggtcgatggtccggccttcgaccggagccacgcagaccagcacgtcgtcctcgcccatctcgctcggcacggcgacgacggccgcctcgcggacatcgggatgggccgtcacctcggcctcgacctccagcgacgagatgttctcgccgcggcggcggatggcatccttgcgccggtcgacgaagaagtagttgccctcggcatcgcggatgaacgcgtcgccggtgtggaaccagccattgcgccaggccccggccgttgcttcggggttgcggtaatagccgctgttcatcgcccagggccggtcggtacggacgatcatctcgcccacctgccccaccggcacctcgcagtcattgtcgtcgaccagccggacctccacccctggccgcatccggccgcaggtgcccttgagcggcgggttggcttccgagacgatcgggcttgaaatctcggtcatgttgaagatggtgcggacctccaccccgaagcgttcggcaaagaccgccgcatcgcccaacggcaccaccagcaccagcctgagcccgtgattgcggtcgtcggccgagggcggcagcttttccaggaaggtcgccatcacccccagcaggaacgagacggtgacgccgttgcgccgcacggtctgccaataggtggcggtgtcgaaccgctcgaccagcgcaaacgaggcaccgcgggccagcatcacgaacatcggccccatgccgccgatatggaacatcggcgcattgaccagatagcggtcctcgcccgtgacgaagggccaggcatcgggaccggcattggtgtagatgtgcagatacgacaccagcaccgccttggacggcccggtggtgcccgaggtgtagatgatcgccatcgggtcccagggctcgatccggcgcgcgggcgcggtcagcgtgccggtctcgggcagcagcgcctcttccagccgcaccgccggcagggggcattccggcatgcgcccgcccgagacgatcagccgttccagccgggcggtcggcacgtcgaacagccgctcgaccagatcggcatgaacgatcgccaggctggcatcggacagatcgaccacatgtgcgagcagcgaaccgcgataggcggtgttgatcggcacatagaccgcgcccagatagttcagcgcgaaatagacccggatctggtcgcggccattgggcatccagaccaggacatgcgcgccctgcaccacgccctgctgctgcaggcccagcgcggtctggacgatcagctcgcggaagcgggcatagctccattcctcgccggtgtcgtcgaatttcacgaaaaccttgtccggctgctccacggccagccggtcgacaaggtcgcgggtcaccacccggtcgcgcgggggaatgcgcgcatcgaaatggaccggaccctcggggctctgctcgaccacgatcgtcatcgggacgtccctcccattgcgtgtgtccacggtcgggccggtcgcgggatcgatgcccgcgccggcctcttaatcttctgtcgtctggcgtctcgtcaggccgcgtcgccggcggcggccggcccgccgtcgaagacgtaatccgccggcgccaccgtgcgggtcatgcgccagaagtcgtcattgcgccagggggtgatcgccaccacccggccgcgggaattgcggtaccagttctccatgccctcatgggtccagaccatcttcgcatgggcctcgtcgaccctgcgattgtagtcgtcatggatctccggccgcacttcgatcgtggcggcgccccggcggaacatctcgtcgagcgcgctcaacagatagtcgcattgcagctccaccgccgagatgatgctgccgccgtggccaaggccgacattgggccccagcagcatgaagaaattggggaaaccgggcacggcggtgcccagataggcccgggcatcgtcgccgttccagacctccgacagcgcctgatcgtcgcggccccgcacctcgtaagagcccaggaactcggtcgccttgaagcccgtggccagcaccagaatgtcggcctcgcgttcctcacccccgcgcgagaccagtctgctgccccgcacctcggccatatggtcggtgatcagctcgacattgtcgcgggcaatggtgcggtaccagccattgtcgagcagcatacgcttgccgaagggtgggtagtcgggcagcaccttctccagcagatcctgccggtcgccgagttcctgctgcatgtatttgacgaaggcacggcgatggccgtcattgaccgcgttcagcgcccggtccggatgcggccaggcgggatccttctgcagcgaggcatgaacccggtcgttgaaggtccaggcgagacgctggcgataccacaggcggtagagcggcatgtttgcgatcaggaagcggatcggctgcggcatttccttgccgaattgcgggaagggtgccgcccactgcttcgaccgcgcaaagatggtgagctgccccacctgcggcgcaatcgcaggcgccacctgcatggccgaggcgccattgccgaccagggccacccgcttgcccgtaacatccagatcttcgggccattcggcggtgtggaaacagggtccggggaagctgtcgaggccggggatatgcggcaccagcggcgtgttcagcacgcccaccgcactcaccaccgcatcggcggtcagcacctcttccgcgccgtcgggccggcggacggtcaccgcccagcgccgggcctccgcctgccacagggcgctcagcacccgggtgtcgaaacgggtgcagctctccagcccatgatcgcgcgcgaccttgcggaaatagccgtaaagctcgccctgcagcgcgaaatagcgcgtccagtcatgcggcgcgaacgagaaggaatagatgtggttgggggtgtcgaccccggcgccgggatagcggttctcgcgccaggtgccgccgaaatccgaacccttctcgatcacctcgcaggcgatgccgcgctggcgcaggcggatcgcggcgcagatgcccgagacgccggcgccgatcaccagcaccttgaagccggccggcacagcccccggctcacccagccggtgcgccttcagccccagccccgaggcgatgatctcgccatattccgccggcacctcttcggccatcgacacgctcaacatgcgcaccagcagatcgtcgtccggccgcggcatcgccaccggccggcccgcccgccaggccaggatcgcctcggtcgcagccgcgcggatctccgcctgcacgtcctccggcagaccgccatcatcgttgtcgtccagcccgcggccgcgttcgggtgcatagggcggctccagccagcgcgtgtcgccggtcagctggaccagcaccatcagcagcgtcgggatattggcgatcgccaccgccacccgaaaggcggcgtcctggtcaatgtcgccggcacccgcaagggcgccgtcccggttcgcgtgatcggccatcgtcaggtttccttacccttggcggcaggttcgtcctgcccattgcttctgatacgtccggcgccctgagtgccggggccctgagtgccgggggccctgagtgccggggcctgcagccctccatcgggcatcttgacccgcatcgggtgtccgggtaccgtaattaagtcgaacgttttagtcgatagctttatacgaccggcttatcggtcgtgactggcggagcgccccgcaccaccccgcttgggggggtaggatgaagaagggcgcccgcgcgggaggagtagggtccggatgcctgcacgccacgatgacgcggcgcggttctcgcgcatgcttgatgacaccgtcacgatcgaaggatggtgccacccgcgcttcgccgcggtggccgaggccttcgcccggaatttcaccgaccgcgacgaggccggcgcctcggtggcgctggtccatgacggccggctggtggtcgatctctggggcggcgccgccaccgctgaccgcccctggcaggccgatgatctggtggtggtgttctcggccaccaaggccgcgaccgcgctctcgctgcatcttctggccgaacgcggccggctcgatctggaccggccggttgccggctactggccggaattcgccgggaacggcaaggaccgcgccacggtgcggatgatcctggatcacaccatcggcctgccggtgctgcgcccgcagctgaaggcggactgcatcaccgatgccgcctatatgatcgatcatctggccgccgaaaccccgttctgggaacccggcacccgcaccggctatcacccgctgaccatgggcttcctggcggcggaagtggtccgccgggtcgacggtcgcagcctgggccggttctttgccgacgagatcgccggccccctcggcctcgatttctggatcggcctgccggaagagcacgaggcccgggtggcaccggtgatcatccaccggccaccgcgcgacgcccagaccacgcccttcctgctggcggcgcgcgagccgggcagcatcgccaatctgttcgtgttcaacagcggcgatttcgccatccgcggcgtcaacacccgcgccggccacgctgccgaaatcggcgccgccggcggcatcaccaatgcccgcggcctggccggactctatgcggcgctggtgccgggcggcccgctcggcttctctgccgacaccctggccggcttcgccgaggccagttccgccacccatctggacgcgaccctgctgcagccgatgcgcttcggccccggcttcatgctgcgcatggacaatcgccgccggccgcagccggccgacagcctggtgatcggccatcgcgccttcggtcatgtcggcgccggcggctcggtcggtttcgccgatcccgaggccggcatcgccttcggctatgccatgacccgcatggggccgggtctgctgctcaacccgcgcggccagtcgctggtcgatgcggcctatgccgccctcgccgcctgagcggccagcacatttccgcaccaccgccacaacgacagacggcacccggcacagcgtctggtatgccgcacgcatctgcaccacacgggaggacatccaccatgaagacgatccaggggatcggtctcgccgcgggtctggccgcgctgaccatgaccgccaccaccgcctcggccgatcagctgcgcttcgcgatcggccatccgccggcctcgttcctggtcaaggcgggcgagaccatggccaagaccatggcggcggagaccggcgatgccgtcaccatcaaggtcttccccatgtcgcttttgagcatggccgagacctcgggcgggctgcgcgacgggcttgccgatatcggcacggtgatgagcacctatttcccggccgagtttccgcacaccaacctgctgctcgaagcctcgatgatgctgagcaccctgccggaagatccgaccggcgtggaggcacaggcctattcggcggccatggccgaatacatcctgacgaaatgccctgaatgcaatgccgagttcgcgaagcagaaccaggtctacaccgccgcggccggcacgccgggctatgcgctgaactgcacgaagcccgtggtcaccatggacgacctcaagggtgcgcggctgcgcatcggcggcgccaactgggccggctggtcggaagcggtgggcgcggcccccgtcaccatgtcgggcaacgagatgctggaggcgctgagccagggcgtgctggactgcatcatcctgtcggtgccggacgtgcagaatttcggcatgggtgagtcggtgaagcacatcaccatgggcgcacccggcggcgtctacgtcgcctccatggcccaggtcaaccgcgatgcctggcaggatctgtcgcccgaagcccggaccgccctgctgaaggcggcggcgctgggctcggccgaggcgagcctcgcctacgagaacaaccaggccgacattctggaaaaggtgaaggccaagggcgtccaggtccatcaggccgatccggccgtggtcgaggcgacccgcagcttcgtcgaaggctatctgaaggcgatgcccgccgcctatcagcagcgttatggcgtgacccgcggcgaggagatcctgaccgatttccgcacgatcctgatcaagtgggtgggcctcgcccgcaccgccaagacccgcgaagacctggcccggctctactgggacgagatctattccaaggtcgacgtgaacacccacggcatgtgatgccatcccgccccgaccaggctggccggggcgggcttcgcacgatccccagaacccgacaggtcccgttcccatgtcgacgcccggccgcctgcttgcgcggacgacctcgctcgcgacgctcatcgccggcatcgcgatcgcgctgatgatgctgcacgtctcgctcgacgtcgccttccgctatctgctgggcgcgcccctgcccggcaccctcaccgtcgtcacctattactacatggtgatcgccgccttcgtgccgctcgccttcgccgagttgcgccgcgcccatatttccatggagatcgtgaccgatctgctacccagacgcggccgcaacatgctggaaggctggatgctggtgcccacgggcctggtcaccggcctgctcacctggcgaggtttcgaagaggcattgaaacagcaggcgatcggggcggcccagatccagggctcgtccagcatcccgatctggccggcctattacgcgctgccgctgggcgcgggattgatgaccctgctggtgatctaccgcttcgtcaatttcctgcgccggcggcccgacgacctggcagccgccacctccggacgggaggcggggctgtgagcgacgttcagatcggcctctccgggctgggcctgctgctggtgttcatcgcgctgcgcatccccatcggcatctcgctgatcggcgtgtccttcggcgggctctgggtactgatgggctggaaggtcgcctggggctcgctcggcctgctgcccttccagttcgcggccaactgggtgttgagttcggtgcccatgttcctgctgctgggcttcgtctgctatcacggccagctgacccagggcctgtttcgggcggcacgggtctggctggaacgggtgccgggcgggctggcggtggcggccgtgatgggctcggccggtttcgccgcggtgtccggctcgtccatcgcctgttcggcgaccatgggccggatcgccatccccgaaatgctcaaggcgcgttatcaccccgaactcgccaccggctcggtggccgtggcgggcacgatcggcgcgctgatccccccctcgatcatcctgatcctgtatggcgtggtggcccaggtgccggtcaccggcctgttcctgggcggcatcgccgccgggctgatcaccgcgctcggctatgtgctggtgatcatgatccgggtgaagctgaacccggcgctcgcccccgacgtcaccatccgtacgccggcatccgaacggatcgcagcactgaaggacacctggccggtgatcctgctgatgatcggcatcttcggcggcctgttctcgggcgtgttcaccgcaaccgaggcgggcgcggtcggcgcgctgatggcggtggtgatcgcactcgccaagggcacgctcacccgcgcgcggttctcgaccgcgatcgtcgacacggtgctcaccacctccacgctgatcatcatcggcatcggcgccactctgctcacccgcttcctggcgctgtcgggatcggccgattatctctcggaacaggtgctggcgctgggggccgatccggtgctgatcatggccggcgtcgtgatcgtctacctgctgctcggcctgttccttgaaccggtcggcgccatgctgctgaccctgccgatcgtgctgccgatcgtcgacggcaccggcttcggcctgctctggttcggcgtgatcctgaccaagctgctggaaatcggcatgatcaccccgccggtcggcatgaatgtctttgtgatcaaaagcgtggtcggcgatctggtcaagacctcggccatcttccgcggcattctgtggttcctggtcatggacctggccgtgctcgcgctgctgatgctggttccggaattgatcatgtatcttccgacccgtttcggataaccaatggtcagacgacccgcagccagccgtcggaagacccaggagcagcgcatgtccgccgaacccacccccctcgccggggagaccacgcagaccgatcccacgcgcgagaagctgaagctcgcggccatgcgcctgttctccacccgcggcatcgacggcgtatcggtgcggaacatcgtcaccgaagccggcatgcgcaacggcgcctcgctccactattatttcggatcgaaagaggggctgatccgcgaactggtggtcgaggcggcgcagcgcagcgatcgcgcccgcaatgcccggctggacgtgatggaggccgagggcggcccggagcgggtggccgatatcgtccgcctgctgctggaggtggagacaacgggcgccggcgaccccgacgcccatcgcagcctgccgatcggcttcggccatatgcgcttcatcgtcgccatgcagatcaaccaccgcgccatgttcctggacgcggtgggcgatcgctggcggtcgagctatatgcgctgcatcgaccatctgcgccggctgatggtccccctgcccgcggcggtgatcagccagcgtctggcgcatatggtgctgttcatgaacaccagcctcgcggtacgtgagaccgccttcgaggccgaccccaccggcggcgggctctggggcaagccctatgcgctcgactgcctggtcgaatcgctctgcggtgcgctggaagcgccgctttcgcccgaggtggcggcggtgttgccggggtgaggccgccgtcgccacgagactctctgcatcagaggagacctgcaatggcaacgatgaacgtatccctgcccgatgcgatgaaggcctgggtcgaaggccaggtcgacggcggccggtatggcgacgcaagcgactatgtgcgtgacctgatccgccgcgaccgtgcccgcaaggaagcgatcgccgcccttcagaccgcggtcaccgacggcaccgacagcggcgagccgcaggcgctcgacgtcgaggccttcaagctgcggatgcgcgaccgtcatctcatccgctgagccgcccgcctcatctcaaccagccttcccatcctcccccgccgcggaagcggcaagcgtcgcctgggccgccgcggccgcatcgccgccctggcccgagaccgagacggtcgggaaggcgaaggcgatgtcgttggcctcgaaggccttcttgatcagcgcataggcgcggcggcggatgacgaactgttcgccgggcttggtcatcatcttcaggcgcagctggatggcataatcgccgaactgctccacgccctgcatcttcagcgtctcgatgatgttgggggcgaattccggatcctgctgcaggtcgcggccgacctgtttgatgatcttcttcaccttgtcgagatcggcggcataggtcaccttcaccgtcagcttgtcgatcacccagtcgcgcgaataattggtgatcttgtccagagagccgaaggggatggtgtgcagcgcgccccggtggtggcgcagcttcatcgagcgcagcgagaagctttccaccgtgccgcggatattgccgctttcgatgtattcgcccacccggaaggcatcgtcgaacaggaagaacatgcccgagatgatgtccttgaccagcgtctgcgcgccgaaaccgatcgcgacgccgaccacgccggcaccggcgatcagcgggccgatttccacccccagcgacgacagcaccatcagcagggtgatcacccccagcaccgccagcagcaggttgcgcaggatcggcagcaaggtgcgcagccgcgcctgccggcgcagggcatcctcgccgccggtcgcgccgtcatgggcggcccgcatcagccggtgatcgatccaggccgccgccagccgccaggcgatgtcggcgacgagcacgatcaccaccgcctgaaagatcccgcccatcgcccgctgcagcggggtctcgcggcgggcaagctcggtcaggtcgtaatcgatgatgccggcgatcagcaccgccgctcccagcagccagaaagcccggagcccgcggccgaccgaaatcgcgatcatcgaaggcgcaggtcccgccgatatcatcatgccgccgccctcgccgccgccatgaccggcatggacgatcgcggccggctccggctccacgccctccggatgttcggtcggccggacgaaatgggcgacagcccggcgggtggcaggcagcagcaccacgaacagcagcagcagcacgatcgccacctggaagggctgaatcgagcccgtgaacagcagcagccagacgccgaccagatagatcgagaacagccaggtggccaacgcccggcgccgatgggcgcggccctcgccgtcgatttcgggccgggtccaggtggcgatcagggtcagcagaagcaggaccagccccatgcccagccccagcgccgcccagggaccgggcgccatgcccagcccgtgcaacaggtcgagcgtaacatcgcccagcccgtaccaaccgaccagcaccgccgaccacagcatccagtgccgggcggcggcatcactcatcggcacgatccggaagcgcggcacctggggcgagagcagaatgcggccgaaccccgtcaccagccgcagcatcagcacgatcagcagataggatgcgaccacctggcgcagcatcggcggccagggcatcacggcaaaggcgccgatgctgcccagcgcgaaagcggcgagcacgcccaggccataaagcgtccgcagccccgccaccctgagccgcatgcgcggccggtcggtcgggtgcgcctcgatccgccggcgcagcggccgggtcgcccgggtgaaggcccattcgaaaccgcagccgagcagggcgaagcccagcaggggcaggatcaccccgccggtcccggcaccgatccgcgcacggaaggtgcccgctgccgccgccagttcggccggaatctgcggcagcccggctttcagcgtgccgaggaaggcgcggatgccgtcgatacgggcggtgagcaggcgctcggccatcatgcggcgctcggccgcatcggcgggcagaatggtcgtctgggcgggcggtgatgcgggcgcagccgtcccggccgcggcctgtgcggcaatccaggcctggatcgtggggtcggcaagaagccccatcaattcccgcacccgctcgggatcggcgggtgcgggggccgcggcgctctgttgctgggccagcatcatctggggcatggccgccacggccgggctgccgccgcctgccagcatcagccacatcacacccgccaggaccatgagcatcatgccccgcccgttgcccgccatcccgccagtcctcccgccccgcaaggtctcgcccacggcgtcgctttgccgacgcgtgaccgcacgcgatcatgaggccagccgcgggcggcttcaatggcgatccgcagggcggatgggctataaatggcccgctcaccaccttccttatcccagggacacacgccacccatgaccgccccgctccatcccgatgccgccgcctggaccgccaccgtcgacagtgccgaacacgggacgctgcggatcgaagggcgctgccatccggcttacgaggcggtggcccgggcattcaccaccaacttcgccgaacgcgacgaggtcggcgcctcggtggcgctggtccaggacgggcggctggtggtcgatctctggggcgggctggcggtgcgggcgggtggcgacagcccggcccggccctgggcggaagacacggtttcggtgatcttctcggccaccaagggcgcgaccgcgatcgcgttgcatctggcggcggcgcgcggcctgctcgatctggatcagcagatcgtcgaaatctggcccgaattcgccggccgcgcccccgaacccgggcccaagcgcgcggcgacggtgcggatgatccttgaccacagcatcggcctgccggtgctgaccgcgccgctcaaggccgattgcgtcaccgattatccctatatgatcgcccggatcgaggaagaggccccgctctggcagcccggcacccgcaccggctatcacccgatcaccatggggttcatggcggcagaggtgctgcgccgggtggatggccgcagcctgggccggttcttcgccgaagagatcgccgggcccttgggcctcgatttctggatcggcctgcccgagagcgtcgagccgcgcgtcgccccggtgatcgtccgccgcgcccagcgcggcgccgacctcacgcccttccttgccgcggcaaagcagccgggcacgatccagcatctgttcgtgttcaacaacggcacctacagcagccgcggcgccaatacgcgcgaaggccatgcggccgaaatcggcgcggccggcggcatcaccaatgcccgcgcgctcgcctcgctctatgccgccaccctgcccggcgcggcgctcggcttcgacgccgacaccgtcgccggcttcgccgaggccagctccgccacccagatcgatgccaccctgctgcaacccacccgcttcggcccgggcttcatgctccgcatggacaaccgccgccgcccgcagccggccgacagcgtcatcatcggccaccgcgcctacggccatgtcggcgccggtggctcgatcggcttcgcggatccggaacggggcatggcgttcggctatacgatgacgaagctgggggcggggctgctgctcaatgcgcgggggcaggcgctggtggatgcaggagccgccgcgacggatggccgcgcgggataaagcgcatatcgcagtttagaatttatcaaatgtcaaagcgcggggccggggcggccctcatccttggctcacgatgacgccggcaacggcgatcgccatcgaaacccgaagccgaaggatcgaccgccatgaccaccacccccggtttcccgcgtctgaacgagcccgccccgcatttcgaggcgcggacgacacacggtcccgtctccctcgccagttacaggggccgctggctggtgctgttcgcccatccggcggatttcacgccggtctgcacgaccgaattcatcgccttcgcccgcgcccatgaccggttccagaccctgaattgcgacctgctgggcctgtcgatcgacagcgtctttgcgcatctcgcctggacccgcaacatcagcgagaagttcggggtcgagattccctttccgatcatcgaggacatctcgatgaacgtcgccaatgcctatggcatggtccatcccggtgccgccgacacccaggccgtgcgcgccaccttcgtcatcgacccggaaagccgcctgcgcgcgatgatctattatccgatgagcaatggccgctccgtcgaggaaatcctgcgcctggtgaccgccctgcagacgagcgacacccatggcgtggccacgcccgaagcctggtgccccggcgccaaggtgatcgtgtcgccgcccaagacggcagccgaagccgaggcccgtgccggccagggttacgagacgacggactggtacttctcgcaaaaatcgctctgacgacatccgggcgcgcccccgccatggcctgtccgcccccggaaggagagatgaaatgaccgtcctgcgaacggccgcgcttcttgccggcctctgccttctggccgcgccggttgcggccagagacagcctgttcgtcaccgtgaccagcggtgacccccagacccaggccatggccatggttctgtcgcagcaggccctgcaacgtcagacgccggtgcgcatcctgctctgcggccccggcggcgatctggcgcggaaggattatcagggccctgccctgaaaccttccggcagaacgccgcagcagatgctccagggcctgattcaggcaggggcacatgcagagctctgcgcgctcaatctgcccaacagcgatggcctgaccgcagccgatctgatcgacggcgtcacccccgtgacaccgcctgtgatcggtgaacacatggaccgtcccgatgtccgctatctcggcttctgacgggccgggtggctgctgctgccgttcgggcgccgtgcgaacatcacgatattgccgaacacgatcaggcacagcccggcggcggccgtccaggtccattgatagccttcgaacagggtcgagatcagaagggcgaccatcggaaagaccaccgtcgcatagcccgcgcgggccgagcctatcttctgcaccagcagcagataggtcgtgaagccggcgacggagccgatcacggccagatagatcagcgccgcccaggaggtcatgccctcgggcaggacgaccggctggcccgtggcgaggatcagtatcagcaggacgacggcccccactgcccatcccccaggcattggccgtaaccggagaggtgccgagcgcactgttcctgcgcgaggccatattgccgagcgagaacatcatcgtgccgaaccccgcccaggcaatgccgcgcaggctgttgccgtcgagcgtggtgaacaggtcgtgccagaacagcaggaccagcccggacgccccgatcgcgccggcaccgacgacgcggagcgtgatgcgctccccgaagaagatccgggcattgaccgcgttgaagatggaggcgagcgagaagaccaccgaaaccagccccgacgggatcagccctgccgccttgtacagcccgacgaagttgaacgaaaacaggcacagggcctgcaaggcgacgaaacgccagtgtgccgggcgcgccagacggcccatgagggcgagcccggcgagcatcaccagcccggcaagcgcgaagcgatagaagatcgagaccatgacaggcatggcgccgacctgcagggcgatcgcgatccacgtcgtgccccagatcagcacggtggcgatgaagagaagggatgtgttcatgcgcgcagcataggccgggccgccccggcggttttgcatcttcttgcgcaaatccgcaggccgacacttttcccggcgcaccggccgacctaacatcgaccgacgcacccaacggccggcaccccatgtcccaccagcccacgtctcacattgcgacctcccgtccctccacgcccgacaccatctacgacgtcctgcgcagatcgccggtcgcccgggtactcgccggcatggagctgggcgaaggctgtgcggtcacggtctgggaaaacacccgcgatcgggtgtgctatcaggcgccggcccatacgaccttcagcctttatcttgagggcggcaccggaacgcggcggctggatgccggcggggttgccggctatccgggggccatctgcgtgatgccggagggctgcggctccgactgggagatcaacgcccctttccgcttcgtgcatctctatctgtcggaagccaggctgcgcagcggcttcgtcagcacccatgactgcgacgcccgcagcctggacctgccggaagcgaccttcgtccggaacccggatctcgccatccccctcgcccagcttgccgccgccggcgccgagggggatgttctgcatgccgaaaccaccctcgccgagctgttcggcgccctgcgcaggaagccggtgaccatacgcgcgggccttgcgccccatatcctgcgccgggtcgacgactggatcgacgcccatctggaccagacgatcacgctggacgaccttgccgccctggccgacctgtcgggcttccacttccaccgcatgttccacctgtcccgcggcctcgccccccatgcctgggtcacctggaaacgcgtcgcccgggcccgcatgctgcttcgaaccgaccagcccatcgccgccatcgccgccgcctgcggcttttcaagccagagccacctgacgcgcgtcttccagcggcatgtggggaagacgccggcggtgtatcggggggcggtgatcggaagcatccagagacatggagcgttccgttaggtgcacttgcccgtcattcactgttccttcctatacctcatgagactcgtcgcacatgcgagcgccgagaacgcgctgccgagccagagagcggtcatggagcctgcctcgcctgcaaccgtgaagcaggcggccaccagggctgtgcccagagcctggccgagcaggcgggccgtcgggatgatgccgcttgctgcgccggcccgctctcgtggcacgctcgccgtcagggccttcaggttcggggattgaaacaggccgaagcctgcgccgcagattgccagccgccatgcgatgtccggaaacgttgcctggtccggcaggaaggccagcagcgccatgccgaggcagagcagcagcaggccgacaccccccagaaccgcaaccgaccggcgttccgacaggcgccctgcaatcggggcgacgacggccaccatgaccggccatggcgttaagagaaggccggtttcggtctgtgatcgccccatgaccgtctcaaaaaggaacggcagagagacgaaggccagaccttgggcagcgtaggcaaaaatcgacgtcagaactgacagggcaaaaagcggccgacgacataaatcgacgggcagcagcggcgccggatgcccgcgctgtctgtagaggagcgcaccgaagcagacaagggatgcaccccattcgcacaatacccgcaccaggccggcctggtgggccgcatctccgagccccaggatgagaaggccgaacatgcccgcgaccaatattccgctggtgccgtcaaatgaatgggatgcccgttcgccggttgtgctgggcaaagctctgaacgccagcaccacggcaaaagccccgagcgggatgttgatcagaaacagccacggccaggtggttacagccagaacgcccgaggcaaccagggggccgatcgcgaagaacacggcgacgatcaaggcattcagaccttgtgcgcggccaatctgactatgcgggtagataaaccggatgagggcactggtgacgctcaggatgcccgccgcaccaataccttgcagcgtccgggctgcaatcagcatcggcaatgatgacgccagcccacatgcaagagacgcaagcgtgaagagcgccaggccgcccgtatagacgcgtctgtgcccgacgatgtcgccacaggccgcgaggggcagcagcgttgcgaccatcgccagctgatacgcattgatgatccagatcgacatttccgggcttgcgtgcaggtcggccgcgatggttggcagcgccgttgtcgcgattgtggtatccagtgtggcgatggcgcttcccaggatgagcgttgccaccgcccggagcttttgcgcccccggcaggccgtcgctgatatcattgacctggggttggctttcgaacgcggaaatggcgggcgctcctgtggatggacgcggttcccagaaggcgccttcccgaagatggggtgtagaggctgcctgcctgagagccttcggtgacggagcctagcccggccaaatcactttgataattttgtacttctttcaaaattgttttgataaatttaatcatggctatgcctcccaacctcgatatggatgtccttcggacgttcgtgaccggcagcacgctcggaagcttcgcgaaagcggccgagcggatcggacggtcgccgcccgcgatcagcctgcaacttcgcaaactggaagcccaggtggggcagaccctgtttcgtaaacagggtcgcggcctcgtgctgacagaggcgggcgaaatcctgctgtcttatgcaaagcgactgcttgagttgaacgatgaagccatgatggcgatgcaacgcctcaccgatatggagggacggatccgtcttggtattccgcaagacttcgccgatacatcgctgcctgtgctgcttggtcgcttctcacgcgcctatcccaaaatcagggtgactgttcgtgtagagcgcggctcccatctcgtgaggctgatcgaagccggcgacctggatctcgccctgacctggggcaatctgagcagtgctcaccattcgattatcggcagctttcgtgtcgtctggatcgggccagacgcatttgaccgggagccggacatgcctgttcctctggtggcgttcgatccgccctgctcgtttcgggcaagggcaatcgacgcgctggagaaagatggcattgcctgggagcatgtattcgccagttccggtctggccggattgtgggctgccgtgacggccggtttggggatcacggcgcggatcgcagacgtcgtgccgtcgcatcttcgcgtccttgatgcaacctcgtgcggtctgccggcactcgggacgatcaatctgggcctgcatcttgctgacgcgaccccgtcaagcccggtaaagcgcttcagcgagcttctcgtcgaaactgtctccgacatcagatgacggccgggtgaggtcgcgccccgtagcccccacccgccgaaacgccgccggcgacagtccgaacgcccccctgaacatgttgatcagatgcgaggcatcgcaaaaacccgtcgcatgggcgatgtcggtgaccgtgcgcggtgtggtcgccagcaggtggcgggcggcgtcgagcctgaggcgctggccggcccgcgccggggagaggccgagatcggcctggaagctgcgttccagcttgcggcggcccacgcccagatcggcggccagctcgtcgacggtcgccgggtcctccagccgctggcgcatgcggatcagcgccttgcgcaccagcgggtcgcgggcggtgagcgggctgccgccgccgggctggggtttgtcgccggtcatcgcctcgtcgatgatcaggatgctgaggcttttgatcgccgcgacccggccgatatgggtttcgaccagccaggccgccagatgtgcagcactgtggccgccggaacaggtcagccggtcgcgatcgaccacgaaaatctggtcggataccggccgggttgaaccgaaacgttcaagaaaatcgtcatggtggaaccagctgacgcagcagcggtagccgtcgagtagccccgcctcgtgcagcaggaacacccccgtacacagcccgaccagcggcacaccgccccgcgccgctgcctgcaggaactgcatgctggccggcgagaggccgctcgcctcgcgaatcagcccgcccaccaccacgagataatcataggtcccggcccggtcgagccgggtatcgggctgcaccttcacgccgcagctcgaccggatcgggctcatatcgtcggagagcaccgtccagtcgcagagaatcggccgcgaccggtccgcctcgtcggccgcaagtcgcagaacatccacgaaatttgcgaaggccgagagcgtgaaccgatccgcgagcaggaagccgacacgcaggcgtttccgggctggggtcatgacgcaattctacaacgcttccgtcgcaggcttccagtcccgaggcaggatcccgcgcctagaatacccgcaaagctggagcgttgagggctggccgccatgacccgtttttccgccatgtcgctgttgaagaatgccctgaccggccacaagggctggacggcacaatggcccgaatgcgaccccaaaccggaatacgacgtggtgatcgtcggcgccggcggccatgggctgggggccgcctattatctggcgaaagagcacggcatcaccaatgtcgcggtcatcgacaagggatggctgggcggcggcaataccgggcgcaacaccacgatcatccggtcgaactatctctatgacgaaagcgcccggctttacgatcatgccgtcgatctctgggacgggctgtcgcaggatctgaactacaacgtcatgtattccaagcgcggcgtgctgatgctggcgcataccgtgcacgacatccagagtttcaagcgccacatccacgccaaccgcctgaacggcgtcgacaaccgctggctgacgcccgaagaggccaaggcttattgcccgccgctcgacatctccccccgcgcccgctatccggtggtgggcgccgccctgcaggaacgcgccggcaccgcccgccatgatgcggtcgcctggggctatgcccgtgccgcggccgcgcgcggcgtcgacatcatccagaactgcccggtgaccgaaatccgccgcggccccgatggccgggtgaccggggtcgagaccgcgaagggcttcatccgcgcgaagaaggtggcggtctccgccgccggcaataccagcgtggtgatgcagagtgccggggtgcggctgccgctggagagctacccgctgcaggcgctggtgtcggaaccggtgaagccggtcttcccctgcgtggtgatgtcgaacacggtgcatgcctatatcagccagtcggacaagggcgaactggtgatcggatcgggcaccgatcagtataccagctattcccagcgcggcggcctgccgctgatcgaacacaccgtcgcggcgatctgcgagatcttcccaatcttcaaccgcatgcgcatgctgcgcaaatggggcggcatcgtcgacgtgacgcccgatcgctcggcgattttgggcaagacgccggtgccggggctttatgtcaattgcggctggggcaccggcggcttcaaggcgacgcccggcgccgcccatacgctggcctggacggtggcgaaagacgagccgcacccgatcaacgcccccttcacgctggagcggttcaccaccggccgtctgatcgacgaagccgcggccgccgccgtcgcgcattgaggatcgccccatgcttctgatccactgcccttattgcggcgaaaccctgcccgagctggaattcgtctatgcgggcgaggcccatatcgcccggcccgaccccgccacggcgaccgacgaggactggcgcgactttctgttcatccgcaacaacatccgcggcgcccatgtcgaacgctggcgccacgtccatggctgcggccggttcttcaatgccgtgcgcgacacggtgagcgaccgcttcctgacgacctatcgggtcggcgatccccgccccgatctcgcggccctgaaggagcgcgcagaatgagccccgccggttttcgcgttccgggccgcggccgtgtcgactatggccagccggtcaccttcaccttcgacggccggcgctatcaggggtttgccggcgacaccgtcgcctcggccctgctggccaatggcgtgcatctgatgggccggtcgttcaaatatcaccgcccgcgcggcgtgctgaccgccggatcggaagagccgaacgccctggtcggcacccgccgcggtcccggccgcgccgagcccaatacccgcgccacggtgcaggaactccgcgccgggctggaggtcaccagccagaaccgctatccgaacctgaagctggatctgggcgcgatcaacgacagcctgcacatgctgctgccggccggcttctactacaagaccttcatgtggccgaagagcttctgggaccggttctacgagcccttcatccgcgcggcggcggggctgggcgtctcgcccgccgaacccgatccggacggctatgcctcgcgctatctgcacaccgacctgctggtggtgggcgccggccctgccggcctggcggcggcattgacggcggcccgggccgggctgcgggtcaccctggtcgacgagaccgccgaggccggcggcagcctgctcagcgagccgcaggccgtgatcgacggccgcccggcctgggactggctggcggcgaccctggtcgagctctccggtctgggcgtgcgtgtcctgacccgcaccaccgcgatcggctattaccatcagaacatggtcgggctctgccagcggctgaccgatcacctcgacgccccggccgcaggccagccgcgcgaacggctgtggcgggtgcgggcgggccaggtggtgctggcccagggggccatcgaaaagccgctggtcttcaacggcaacgaccggccgggggtgatgctggccggcgcggcccagacctatctgaaccgctatggcgtgcgggtgggcagctgcgcggtcgtcgtcaccagccatgacagtgcctggcacgcggccttcgatctggccgacgccggcacccggatcgcggcgatcgtcgataccagaagccaggcccccgcggcgctcaaggcggccgcagaggcgcgcggcatcacggttctggccagccacaccgtcaccggcaccgccggccggctgcggatccggtcggtcgaggtcaacccggtccggaacggccggatcggggcggcggtcaggatcgactgcgactgccttctgatgtccggcggctggacgccgtcgctgcatctgttctcgcacaccaagggcagccttgtctgggatgcggccgcgcagaccttcctgcccggcacccgcaccgaggcctgccagatcgccggggccgcccgcgggttctggggcatcgccgcggcgctggatgacggcgccgccatgggggctgccgccgttcgcgagctgggcggagatcccgccgcagccggccgccacaccgtcaccgacgaccggccggggacgggcgagagcgtgaccgagcttccgaccgatcgcgagcccgcccgggtgcgcgccttcgtcgactatcagaacgacgtcaccgccaaggatctgcggctggcggtgcgcgagggcatgcgctcgatcgagcatgtcaagcgctacaccaccaacggcatggcgaccgatcagggcaagctgtcgaacatcaacggcctcaacatcgccgccgatgcgctgggccgcagccagccggaggtggggctgaccaccttccgcccgccctatacccccaccaccttcggcgcgctggccggctatcatcgcggcgagcatttcgacgtcacccgcaagacgccgatcgacggctgggccgtcgagcatggcgccgtcttcgaaccggtcgggctgtggcgccgggcgcgctatttcccgaaaccgggcgaggacatggatgcggcagtcgcccgcgaatgccgcgccacccgggcgagcctcggcatcttcgatgcctccacgctcggcaagatcgaggtggtaggccccgatgcggtcgaattcatgaaccgcatgtacaccaacccctggagcaaactcgccccgggccgcacgcgctacggcctgctgctgggcgatgacggcttcatccgcgacgacggcgtcatcggccggctgaccaccgaccgcttccacgtcaccaccaccaccggcggtgccgcccgcgtgctcaacatgatggaggactatctccagaccgaatggcccgacctcagggtctggctgacctccaccaccgagcagtgggcgaccatcgccctcaacggccccaatgcccgcaacctgctcagccccttcgtcgaggggctcgacatctcggatgccgccttcccgcatatgtcgatcaccgaatgccgcgtcggcggttttccggcccgcctcttccgggtgagcttcacgggcgaactcggcttcgaggtcaatgtccccgcccgccacggccgggcgctgtgggacatgctatgggcggccggccagcgctatgacatctgcgcctatggcaccgagaccatgcatgttctgcgggccgagaagggttacatcatcgtcggccaggacaccgacggcaccgtcacccccttcgatgccgggctcggctgggcggtgggaagcaagaagccggatttcgtcggcaagcgcggcctgcagcgcccggacctcgcggcccccggtcgccggcagctggtcgggctgctgacccgcgacggccacacccggctggaagaaggcgcgcagatcgtgctcgacccggcccagccgatcccgatgaagatggcgggtcacgtcacctcgtcctatcagagcgtcgcgctgggccggccgatcgcgctggccctgctggagggcggccatgaccggatgggtgaaacggtctggatccccatgcccgatcgcgtgatcgaggccgaggtggccggcaccgtcttctacgatcccgccggcgaccggctgaagctctgacagggagaggctgagaccatgacctccgatccgaccgtcgaacccggcccgctcgcccgcagcagcgcggtcacggtcaccctcctcgccccggtcgcacggttctcgcttcgggcgcgcgccggtgatctggcggcgctctcaggcgcgctggggctcgatctgccgcagaagatcggcgatcgcgccgcggcgggggctgtcgaggccctgtgcctcggccccgatgaatggcacatcctggcgcccgaggccgatgccggacgtctggctgcggcagcggctgccgtctatgacgcggccccgcacagcctgaccgacatctcggaccgcgaggtcacggtgatggtcgaagggccagcggccgcggagctgctgaccatcggctgcccgcgcgacatcgaccggatcgcccccggccgtggctgccggacggtgatggacggggtgacggtgctgctctggcgcgacggtcccgagcgcttccggctggatatctggcgctccttcgccccgcatgtcatcgccctgctgcggaccggctgcgtcgaactggccacgtgttcgtaatacgaacatatatgcgcgaacattcgtccgtcatacgatcaatcgcccatatgcgacatgtaatagagcaccagcagtctccagcccatcttcaggtatttccgcagcttccggaacatccagtcggtcagcgacaaccgacgccgcggcgcccgtctggcgggcgcccggcggcgcggcgaggatttgcggcggcgcgatgttcgcttcttgttccgtaatctgaacatgggggcaggccaggggcggcatctcgcaaagatcgatcgagagccggccccggatatcagctggggatcggagggggacatgccgcggcgtgacgccgccgctgcgtgtgcaccataacggaaacacacgtcttcattgaagcactattacgtgccgatgtgttgcagccggcaatgaaaacggcccagccggcgcagtgccggtcgggccgttgctggttcgcagcgcggtacgggtatcagtcggcttcggtggcgacgaccctgacgatctcgggcaccggccagttgaccagctcccgggggatctcggcgatcacgtcaccccgcagcctgtcgggcagatgggtgcgcagatcgccaagcatgcgcgggggtgcgaccagcaccagccggcggatctctcccgcggcgtgaagggcggcggccttctcggccaccgcgcggccgaaggcatgttccagcgcatcatgggcgttcggatgctcgatcgcactgcgcgggccgatgcggttctgcaaagtgcccggcgcccggacggctcgatcggacaccgtctcttcgcccggggccgtcatctccagaaagacgaccgggtcggatgtctccggatcgtcggaagggcgcaggaacagcgccttgcgaccgtcggcgaccaggatagtggtatgcgggtgcagggtctgggacatcggaacctcccctccatgccggcgtcgggcgtggtgcacggcgcccgatccattccggatcattgcagaggatatatcccctggccccatacggccttgatctgtctcaagttatgcgtgaatccggcaccacccagggttcatgccgtgtccgcacctctgcatatccggcgatctcatccgccagcgacagggtgagcccgatctcgtccaggccgcggaccagcaggtccttgcggaacgggtcgacctcgaagccgaagacctcggccctgcccgcccccataggaagggtgacggtctgttcgggcagatcgaccgagacggtggcaccggggcttgcggccagggcggtcagcagccggtcgaccaccgcctcgtccagcgccaccggcagcatgccgttcttcagcgcattggcgcggaagatgtcgccgaagccaggcgcaattatcacccggaagcctgcatcgaccagggcatagacggcgccttcgcgcgacgagccgccgccgaaattgcgccgggcgaccaggatgccggcgccggcataatccgggcggttgagcacgaaatccggatcgggccggccctcggcatcatgggccagatcgtgcagcagataggggtggtacccatcgccgcgcggccggcgcatgaagcgggccggcagcagctggtcggtatcgacatttgcgagcggcagcggtgccgcgatcgccgtcagccgggtgagcgggcggagcatcgcctgggccatcggatcagccctccatcagccggcggatatccgccagccggccggtcacgcccgccaccgccgccatggccggactcatcagatgggtgcgcgcccccggcccctggcggccgcggaaattgcgattggtggtcgatgccacccgctcgccgggtgccgccagatccccgttcatgcccacacacatcgaacagccgctctccacccagtcggccccggcctcgacgaagatccgggccaggccttccgcctcggcctggcgcttgacccgggtcgagccgggggagaccagcatcggcaccgtcagccgccggcccttcagcagggcggccgccgcgcgcagatcctcgatccggccattggtgcaggatccgatgaacacccggtcgaccggcagaccttccagcttctgccccggcaccagccccatatagtcgagcgtcgccggatcggcatcgcgcggcacatggccgtcgatcgccaccgcctcttccggcgccgtgccccaggtgacgacgggtgcgacggcgctgccgtcgatcacgatctcgcggtcgaacatcgcttcgtcatcgctgcgcagggccgaccaatgcgccaccgcccgatcgaacagcgcccccgccggggcggcaggccggcccttcagccaggcgaaagtggtctcgtcgggggcgatcatgccggcgcgggcaccggcctcgatcgacatgttgcacaccgtcatccgcgcttccatgcccagcgcccggatcgccggcccggcatattcgatcacatggccggtggcaccatcggtcccgatcaccgaaatcagatgcaggatcagatccttggccgaaacgccggcccccagccgcccatccacccacacccggaaggtcttcggccggcgctgccacagcgtctgggtcgccagcacatgggcgacttccgaggcaccgatgccgaaggccagcgccccgaaggcgccatgggtggaggtatggctgtcgccgcagacgatggtcagccccggcagggtcagcccctgttccggcccgaccacatggacgatgccctgttcctcgtcgcccagatcgaacagccgcaccgcattggccgccgtgttgtcgcgcaagagccggatcacccggccgacatcggggtccgccggctcggcatcgcggttgcgggtcggcacgtaatgatcggcgacgccgaaggtcagatccggccgcgccacccgccggcccatgtccgccagcttgccataggcatgaaagctgccctcatgggtgaaatggcggtcgatccacagcaggcgctggccggccggatggacctgcacgacatgcgcatcccagatccggtcgaacaccgtgcgcggcgcccccgaaacggtcgcgggcagggtcatccgatgacacctcttttgcgaagatcggcaagggcggccacatccagccccagcagccggcccagcgtctcgtcggtatcgacaccgaggcggggtgcggcgcgggcgtaatcgaccggcgtcgccgacagattgagcggattggccaccgtcggcaccgatcccagcgccggatgggcgatctgccgcgccaggccgcgggcctgcacctgcggatcggcaaacacccggtcgagcgtgttgatcgggccgcagggcacggccttgctttccagcgccgcaatccagtcgtcggtggtgcgggtggcgaccgcccccgccaccagcggcaccagggcggcacggttggcgacgcgttgggcgttggtcgcgaagcgcggatcggtaccccagtccggatggccggcctcggcggcaaagcggcggaactgttcgtcattgccgatcgccagcaccagatggccgtcctgggtcgcgaaggcctgatagggcacgatattgggatgggcattgcccatccgccccggcgccttgcccgaaaccagataattcatcgcctgattggcgagcgttgcgaccgagacgtcgagcagggccagatcgatatattgccccgcccccgtccgctcgcgatgggccagcgccgccagcacgccgatggtggcgtaaagcccggtcatcacgtcgaccagggccacacccaccttgaccggcccgccacccggcacctcgtcgggctctccggtcaccgacatcagcccgcccatggcctggatcatgaagtcatagccggcgcgcggcgcataaggtccggtctggccgaagccggtgatcgagcaatagatcagccgcggattgagcgccctgaggctctcctggtcgaggccgtatttcttcaggccgccgaccttgaaattctcgatcaccacatcggattcggcggcaaggcggcggatcagcgtcgccccctcctcggtgcccatatcgatcgcgaccgaggatttgttgcggttggtggtcaggaaataggccgcctcccgcgccgaaccatccgccgcctcggcatagggcggcccccagccgcgggtgtcgtcgcccgcacccggccgttcgatcttcagcacctccgcgcccagatcgcccaggatctggctggcccaggggccggcaaggacgcggctgagatcgagcacgcgaatgtgagagagggcaccttcggctcggggggtcgccatagggtcgggctccgtggttcagtgtcgggcggtcggtagcggaaggcgtcgccggcaggccggatcagccgaaggcggcgatgccggtctgggcgcggcccaggatcagcgcatggacgtcgtgcgtgccttcataggtattcacggcctccagattgcacatgtgacggatcacatgatactcgtcggcgatgccgttgccgccatgcatgtcgcgggcgacccgggcaatctccagcgccttgccgcaattgttgcgcttcagcaggctgatcgcctcgggtgccgcgatgccgcgatccttcagccgacccagctgcagcgccgcggtcaggccgagcgcgatttccgtctgcatatcggccagcttcttctggatcagctgggtggccgccagcggccgaccgaacatgatccggtccatggtgtactggcgggcggcatgccagcagaattccgccgcacccatcgccccccaggcaatgccgtagcgggcattgttcagacacgagaacgggccggtcaggccgcggacctcggggaaggcgttctcttcgggcacgaagacctgatccatggcgatctgaccggtgatcgaggcgcgcagcgagaacttgccctcgatcttaggcgcggtcagcccggtcatgcccttttccagcacgaagccgcggatcgagccgtgatcatccttggcccagaccacgaaaacgtcggcgatcggcgcattggtgatccaggtcttggtgcccgaaatctcgtaaccgccctccaccttgcgggcgcgggtgcgcatcgacgaggggtcggagccggcatcgggctcggtcaggccgaagcagccgaccagttcgccggtcgccaggcgcggcaggtatttgcggcgctgctcttcggtgccgaaagcatagatcgggtacatcaccagcgaggactgcacgctcatcgccgagcgatagccgctgtcgacccgctccacctcgcgcgccaccaggccataggccacgtaagacaggcccgcgcagccatactcttcaggcagggtgcagcccagcaggcccagcgcgcccatctcggtcatgatctcgcgatggaagatctcgtgacgattggcttccagcacccgggtctggagcttttcctgcgcatagtcatgcgcggtgtcgcggatcatccgctcctcttccgacagctcgccggcaaggttcagcggatcttcccactggaaggcggggcgggtttcacgggccatggggtcttgtcctcgggtcggggaaggcaggtcgggaaaggcttggctcagattgcggcgcggatgcgggtttcagccccggcgcagtccatcaccggccccacggaggaaagcacggtgacggtggcgtcgtgcagatccggcttcatcgccgcacagccgtcggagagtagcagcgtgggcaggccgcggacatgggcgtcacgcaccgtgctcgccacgccgccattggtgacgatgccacaggcgatcagccggtcgatgccggcgcgcgccagcacgaagtccagccgcgtctgatagaaggcgctgtaggcgaccttctcgacagtgaaatcggccggctgcaactcgtcgaccagggcatggccccagccgccgggcatgaaatcgcccttgcgcaggaaggggcggatctggcgcagatgatcggcgatcatcggctcgccgccccggccgggcaccagggtgaactgggtggagatgacgaagccgccggccgcgcgcagggcatcggccaccggcttcactcgcgccggcagggcggcgatttcaggcgcgccggccccgccacgagcataggcgccgtccgggtgcaggaaatcgttctgcaggtcgacgatcagcagggcggtgcgggcgggctggaagtcggcgaagaaatcggccatgggtcaggctccctcgcggtcgctcttgcgggcgatgaccaggttgccgaaccggtcgaccgtggcataaaggtcgggttcgacgaagatcgtggtgtcgggctgctccaggatcgccggcccctcgaccacgctgtcgaccggcagatccagccgggcatagatcccggcatcatgccaggcgccgtcgacatagaccggacgggtgcccgtgcgggcctgatcgatcccgccggtggtgtgggggccagcacgcccagatcgaatttgggccgggtgccgatcacggcggtgcgcaggttcagcacccgcatggtgccaccttccagcagccggccatagacgccgcgataggcgtcctcgaaggcggcggcgatgtcggcgatgccgaacggcgccggattgcccgccgcatcgaccgcgatctcgaatggcaccggcacggtgtgggtctggcccatataggccatgtcgaattcgaaacgcacggtcttggcgtccagcgtcacgcccgccgccgccagcagcttcagcccgcccgccgcatgctcgcgcatcgccgccgccagcacggccgggtcgaccgcatccagcaccgcattgatggtctggacatagtcgtggcgcatgtcggcgatcacgcagcccagcgccgaggtgacccccggatagcgcggcaccagggcccggcccagcccgacatccttcatcagcgcgccgacatgcagcgaaccgccgccgccgaaaggcatcagcgcgaagcgcttcgggtcgtagccgcgttcgatcgacaccaggcggatggcgccggccatgcgcgaattcgcaacccggatgatggcctcggccgccgccatcggctccagccccagcggcttcgccacctgcgcctcgatcgccgccagcgccgcctcgcggtccagccgggcaagcttgccgccgatcggccggtcggcattgatccggcccagcacgacattggcatcggtcaccgtcggccggtcgccgccattgccatagcagaccgggcccggggtcgacccggcgctttcggggccgatattcagcatgccgcccttgtcgacccaggcgatcgagccgccgccggcgccgatggtggtgatctcgatcatcggcgtgcgcacgaccatgccgtaatcgatcgaggtctgtggcgacagcacggtgcggccgtcggcgatcagcgagacgtcgaagctggtaccgccgatatcgccggtgatgacgttggggaagccggcctggtcggcgatatagccggccgcgatcacgccggccgccggccccgacagtgcggtccgcaccggcagccggcgggcggtgtccaccgacatcaccccgccattcgactgcacgatcaggaattcgccgccgaaaccgtcggcgatcagcgcatcttccagccgcttcagatagccgccgacctcgggttggagataggcgttgagcgcggtggtcgaaaaccgctcgaattcgcggatctcgggcaggatctcggtcgaacaggtgacatggtcgttgggccagagcgcgcgcaccgccgcgaccgccgcgcgctcattggctgggttggcataggcgttgacgaacaggatggcgatggcggcacagcccgcctcgatcagcgcgcgggcctcggcctccaccgcggtcaggtccaccgtctcgcgcagcgtgccgtcggccagcacgcgctcgggcacctcgcggcgcagatcgcgcggcaccaccggctcgaacgcgccccacagcccccaggtcttgggccggtcgcggcggcgcatttccagcacgtcgcggaagccgcgggtggtgatcacgccgatccgcgcccccttgcgctccagcagcgcattggtgccggcggtggtgccgtggacgacggtggcgatccgcgccttgtcgggcacccgggtcgaaatgccgtccaggaagcccgccgactggtcgggacgcgaggtcggcaccttcgagacctgggcggtgcccttggcctcgttcaggaagaagacgtcggtgaaggtgccgccgacgtccacgccgatgacgaaatccttgctcatgggtcgcaatatccgtgtctggcgtgggttattcgggcgtgtagccgtaatcgcgggcggcggcctcgggcgtgaggtagcccagccggatgtcgcgggcgatggcctgggggtcgcgcttcgccgggtcgccataaccgccaccgcccggggtttccagccgcacccgctggccgcggaccagcttcacgccgatggtcttggagaccttctccggctcgtgccagccgtcatcctgctggtagtggaagcggttgagcgccgcctcgccgccgccgaccacgcccttgggcgcgaacttgccgcgctcgccgaacaggaagacctgggcgtcctgttccagcagctcgatctcgtagacggcacccacgccgccgcgcgcctggccggggccggcactgtcggggcgcagcgcccattcggtgaacatcacgggataggccgcctccaggatctcgaccggcgggatggtggcagtcgaaatcggcgcattgccgtggttcagcccgtctcccgccgggctgccgcccagcccgccgccatagaaggagaacatcacccagcgccggccgtcggcccggtggccggccagcgacagggcattgatcgtgccataggcattgccgttcacccggtccggcgccgcgtttgcaaaggctgcgaagatcacgtcgatcatccgcaagatcgtctcggtatagccgccgaccggcttggggaattcggccgagagcagggacctgtccgggatcacgaagtcgatcggccgcatcacgccggcattggccggcaggtccgggaagatgtgcttgatcgccacatagcagcaggcgatggaggtagagcggctgatgttgatcggcccctgcgccggcccggccgagccggtgaagtccagtgtcagccggtcgcccctgatggtcagcgtcagccggatcggcagtggctcgtccgagatgccgtcattgtcgaggaagtcctcggcttgccagctgccgtcgggcaggcccgaaatggcggcgcgcatcagcgtctcggcccggtcgcccagcgcatccagcgccgccttgaccagatcgggcccgtattcgtcgagcagcgcatccagccgcttcacgcccagatccagcgcgttcagctggccgttcaggtcgccgaaggccgaattcggctggcgggaattcatcagcaggatgtcgacgatgtcgcggttgagcttccccgcgcgcatcaccttgaccggcgggatgaccatcgcttcctgaaaggcttcggtcgcgaccgggttgtaattgcccggcacattgccgccgacatcgtgccagtggccgaccgaggccagatagcagaacacccggccatcgcggaaatagggccggaccagccgcatatccgagaaatgggtgccgccggcataggcctcgttgaagatgtagacgtcgccgtcttccaggtcaccgtcgcgggcggccttgtcgatcaccgatttgaccgcgaaggccatcacgcccacgaagatcggcagtcccgacttgccctgaaccagcgtcgcgccgctcaaagggtcgtaaaggccgtgggaggcatcatgcgcctcggcgatgatcgggttgaaggcgctgcggaacagggtcgcgtccatttcgtcggcgatctgttccatgcggccggcgagcaccgccagcgtcacgggatcgatggcactcacgtcacgtggtctcccagaggcatgcatccggccggcggtatcgatggccgccgacgcgttctgatctcttatccgttctgatccgtcattcgccgaccgacaggcgcgcgggcttccagccgccgtcctcgtcgtcgctgcgggtcaggtccatgcggtattcgaaccggccgggcacgtagagcgagaccagatggtcgaaaggccgcatggcctggtcgtacatggttcgggtcagccggagcagcgccgccccgggctcgacctcaagaagcaccgccagccggtcatcggccaactgcgccgacagcttctgacgcgcggccgcaaccgcgaagcccgcctcctcgaacaggcccaggcgcggacgatgcgccaggctccgctcggtgaaggcggcggccgcggccggcagggtatgggttgcaagcagcgcgaagggccgcccgtcggccgaccgcacccgctcggccgcgaccagttcggtgcccggatcgattttcagttcctcggcgatcgccgccggcgccgcaacgcgcgccagcgacaccagccgcacgcccgaccgcgcgccgatgttctgaatggtcgcaatcagcccgtccagcggcgcccggatcggcgccggccggtagtgatgcgtcaccatggtgccgcggccgcgctggcgcgacaccagcccttccgccgccagatcgtccagcgcccgcttggcggtgatccgcgacacgccgtaatcccgcgcgatatccagctccgccggcagcacatcgccgtcgcgcagctccccacccagaatcttctcgcgaaagatgacatagagccggtgatagagcggcgtcggcccctcgcgccccagcgccgcccgcccgccttccccgaccgctccgccttcatccatgtcgtggatctcatcatccgtgtcgctcatggaggggagcttagcgcgggtgatggcataatgctatatgaatatatcattaggacatgtcgctaacgcttttgcactgaagacccacggctgatcttcagcaagtgtcaatttctcatgtttgccgtggccacctggagacattccctgtctttactgactaaaatgcacttgaggtcgctgagatagaaaggcacctattcggccattagccaatcatacatgcagcatgttgcccattcgaaatatatattccacaattaaagtatcctaaattttattgcacatgtaaattttatctatttatattgttgtttgtttacgaagtactataatatatttcactcatgcgcaccaaattacatggtcatttatattatcgaatttttcccagaattaaatttctgacattaatattccacgtacatgaaatcctgcatatttatcaaccttcaccggatgaaaatcccagaagtcgcggagcacctccggatgcggatgccggtattttcgattgtgcggatcagacgagaaaatactcaccaccggagacaggtctgccgctaaaccagaataccaactactcttagccccgtgatgcatgacctgaagaaaaccagcacgcgcaagtcggccttcaggctgatagtaattcttgaacttctggaatctcttttttgtattaagtatcccatcacccgtataaatttgcgcgaacctagtacgcacatccggaggacacggcattctctcattaaaacaaaaaaatctatagtcaccaattggaccggagtatatgaagagtgatatgatgtttctgtttctggaagattttccaaaatttttatcgtataattttttcagtttatcaagttggtgtttgcatgtatttggtttgtttaaaatactccgaaccaaattcatcgcattagttttgaattgatcattaagcttcggtaacatcgaggcatcgttataagggaggaactcccaatcagaggcggctgatatgacaccacctcgttttagataatgcacatttgcatttacgagcttagtgaataactcatcctgtgcctgatcaggaggagaggccacttcgaactttatcgaaacctcctcagattcctctccatctcgcacgcctccatctggcacgggcccgatacgcggagatggcgcttcgtcatctgactcggagggcagcacaaagacgatctcgcctatatcgctgccgtccaagcccctgaggtaactaacagggtctatatagaaaccaaactcagcatccccggatgagaccccttgctgaattgccaaaataagacgctgcagaggtgtgagatatggcaacaatatcatcctaatctgagattcctgcacaagatgcgaaaatccgctgatatgatcattgtcaaaatgtgagagtataacgagatcaaatcttgaaaatctaagacattctctttgtctattgcaatcttttatagaatcatacaataaatctaaactagacgacgttccacaatcgtaaacccaattaaaaaaaggacggccgttttttactatagcgccagaagaaaatagaccttggcccacaggccaccagtccagaaaaagacatgggctgctatattgtgacgaagtcggaacgctatatctcaacgcaaatgatgtcgcagccggaccattctccagttcgcgaatgagcataaaatctcgcaccatcgcttcctgtgccgggaaaatcgcgttgaagcagaggccttttcgtatctgtccaatcagccgttgactcagatcgcgatccgggcgcgaaaaataagccaggatcttctgatccgttaatcgcggcgtgatgttaagcatcccctttataaggctgatttcataatttgataggaatttcatggatttcattccccctcctgggtccccgtggacgactttcattcttcaagacatcgtgacaacctaaaaaggacacctcggcggcgcatgcatttcaatgcgtgttctcaaatacaaaatctctcttcatcctccgaatcataaatccatattattatttaaataggactgagattattgtatcgtacgcaaatttacataaattttttaacccagcgaactgaagcgactacgtaggtgaatctcccaggacaatccatacatgcagcactgtcgctgaaaacggctcctagcataggatatcactcggtaacaatgcacgcgtcttcactcaagcgcaatcagattgggtcccgtcgcttcctgttttctgtgagtttgtatagtcgcatggatccgccgactttttcagcgttcgctacgctctttttcaactcctcgacaccaatcgcaagagaaacaaggagcaacgcggatcgggccatccgcatgacgcgaattgccttggcttccaattcgtcactcccaattgatataccgaagccattactgtcagcggaatcgagcatgaagggcttggcccagccttcactgactcgcagatacgtgtgttccagagcgttgcggattacatgtagttcgcgtgcatctgcagccgttgtctgcttcaactgttcgtcgaaaagttctttcgagagccaatacaagccgcgaagcggtagattgtcgagttcagcgaaccgcggaagcaggcgggatttcccctccgccatccagacatttttaaagctgattcgctcgggtactttcttcaaactccaataccgattcacgagaaatgcgaccttatcaaggagagaatatgcaacacgaaaagccgtccgtacgcgctcgctggctaacgagtaaaggggatagtcaagtgtatcgatgagggtaacggcgtggtcagaataatgtacacgggtgctgctcatcccttcaaagagcatgaaacgtgcggagacgtactcctgcttcatctgactgaatagaccgacaattggtggcggaaggtggccatcgggacggtcatcgaaccgttccatgagcggtggaagcatcaggtcatcaaccgctgctgccggacgggctccgagatcgtttagcggacatagaaacaggcggtgcctgagacaccagcgacgataggcgcgctcagcggtggacttaccttcaccaccggcatcgagatcctggagagccctgactgcttcgacgttgaccgcgcccgcaacatccttcgcctgcatgtcgaagaaggcccttgccgcttgcggatcaccagaatcgtagaatgcgccctccgccagagcagattgaaagctgtcgtaagcgtgcacagccaggatctctcgttcccggtcattaaacatcagccccgcataggctctgatgccgcagcctcggttgccaagcgcgttcgcaaagaggggaataatttcaagagccgagtcccacacagcgatcgcgtcggttgtcctgcccatcaagttcaaaaggttcgcgtggttggtgagaatctggcatcggcggactttaccaagcgccgggaatcctgggtgactggaggcacgcgagagcgcgagcatttcttcctgcacttctggagattcccatgcccaggagcgtcgggtgtttgagatatgcgacattgccgcccaggcattggctctgaaatactcgacgagggctccgtcggcggggacaaggtcgcgctttgaaagttcgtcaagcaggaagagcccacgcttaacagcacgcatagaagaagcgtcggctccgtcatctataatatcaccgatgtgatcgagtgctccccgatcactcatctttgtgatgcttatttgacatcgcttgtttaattcctcgaaatcaattgattgaatcatacttgaaatacctgatgggtgcggattggggtgaaaaggaacacgtgatgcagagcttcgcctgcttggccctgcctaagctttagaactaactacgcgcacaacgcgatgaagaccgcaagaatccaccgcccggaggagatcgtgcatcctcaatctcaacacccccgaggccccaaagcggcaaggcgctttctcaggagaacggcccctcggaatcccccttgacgatataattcaccctatcgttaaatattttcagaaaccgacagggagtgaccgccatgaacgaccccttccgccggccgaccttcgggtccgccgtgttctatgaaaaccccttcgccgccctcgactggctggaggccgcgttcggcttcgagcgcagcctggtcgtcaccgataccgacggcaatctcgcccattccgagatgaacttcggcgacggctacatcatggtcgggccgatctggaccgacagcgtcgccagcccccggcagaccggcgggcgcaatacccagaccgtgcatgttcagctgaaggacgggatcgaggcgcatcacgaccgggcggtcaaggcgggtgcggtgatcacccggccgctggagcggcagttctatggcgacctcacctattgcgcccgcgaccccgaggggcatgtctggagcttcggccagaccgtggccgtggtcggccgcaccgaggccgaggcggcgagcgggctgaagatcgaaggctggttcgagaccgggcccgaatgacggccgctcccgctctggataccgtgctcgccgcactcgccgacccgcatcgccgccgggtggtggagctgctgcgcgcccgcccgcagcgggcgggtgagctggcggacgccatcggcctcagcccgcccgcggccagccgccacctgaaggcgctgcgccaggcggggctgatcgaggaaagccatcccgatttcgatgcccgggtgcggatctaccggctgcgtcccgaacccttctcggcgctcaaatcctgggtcgacgagaccgaacggatgtggtcgcaccagttgctggccctgaaggcgcatctggaggcggaggcgacggaagaatgaccggctcaaaaatcctggtcgcgctgcgcatcgcggcccccacgccgcgggttttccgcgccttcaccgacgagatcggcctctggtggcaggcggacgggctgttcgccttcacccccggcccgcccggccggctcagcttcgatcccaaggggccggaggggcggctgatcgaggaaaaacccgatggcgcccggttcgagatcggccgcatcctgacctgggaggcgccgccggcaccaggcacagccggccgtctggccctgacctggcgccaggcgagtttcgccgccgaccaggaaacccgcgtatttgtcgccttcgacccggtcgaggacggcacaagggtgacggtggaacatctgggctgggatgcgatcccgatcagccacgccgcccgccaccatttccccgacggcattttcctgcaccgccatggcagcttctggcggcggcagctggcggggctggcggcggtcagcgttcgacgatgaccttggcgatcagctcggcggtgttcgcgacgcccagcttgcgcatgatcgcgctgcgatgcacctccaccgtgcgcggcgagatggccagcgcctgggcgatctgtttgctggtcaggccgttgaccacatagcgggtcacctcgcgctcacgcggggtgagtgccgccgaacccggcgcgcggtcctccagccggtcgaaggtccagacgatcaggcggaacgggtcgtcgggggtgagcgtgcggccgcgggcgcgggtccagatgatttcgccactcttgcactgcatgaaccgctcatcctcgtagcgggggccgttttccagccagcgatgccagcgcgcaccggtcttctcgtaatcgacgctcgacgggtagagcacgcgcaccgagcgcccctccagctcggcccgacgccagccgaagatcgcctcgatttcggcattcacccgcaggatccggcggtgggacaacaccatgatgccgaccggtgcgttcatgaacccggccagctccaacccgtcggtcgacagatcctccggctgcatcgccatcctcccgcttacgtagccttctacgtatatcccctgattgtcgggcgcgctgcaaagctttacctgttgggccaaggcagatcgacgagggctgtcgcacaatgatgacgtatgtcatataataacgcctgtcagacaatgaacgcggagagcgcccatggacccgcagatctacatcaccggcagcggccacacccgtttcggccgcctgtcccagaccctggaagagttgatcgtcgaggccgcacgtgaggcgatcgacgaggccggtgtcgatccggccgagatcgatgcgatctatctgggccatttcaattcgggcctggtttccgacagcttcgcctcgtcgctggtcaagggtgccgatcctgccctgcgcttcaccccggcctcgcgctgcgagaatgcctgtgcctcgggtgcggcggcctttcaggccggcatgatgcgcatcgccgccggcaaggcccgcaacgtgctggtggtcggcgccgagaagatgacccaccggaccaccgaggacgtcacccgcgcgctcgccggtgccggctatcagaatgatccggaagaggccgccctcagcttcccgcaggtcttcggcatcgccgcccgcgcctatgccgatcgccatggcgacccgctggacgccatggcccggatcgcggcgaagaaccatgccaatgccatggccaacccgctggcccagatgcacaagccgctgccttacgaattctgccgcgaggtcagcgagcgcaaccagctgatcgccccgccgctccggctcagcgactgctcgctggtcaccgacggcgccgctgcgatcgtgctcagcagcgatcagggccatgccgcttcggccagccgccgggtgcgcatcgccgccgccgagcaggtctcggacaccctgccgctggccgggcgcgacctgatcgccttcgagggcccggcccgcgcgatccgcgccgcctatgaggccgccggcatcggcctggatcagctggatttcgccgaagtccatgactgctttaccatcgccgaactgctgatctacgaagccatgggcctggtaccccagggccagggtgcgcgggcgctggaagacggcaccgtcttcgccgacggcaaactgccggtcaacctctcgggcgggctgaaggccaagggccatccggtcggcgccaccggtgtctcgatgctggcgctcggcttccgtcagctgaccggccaggccggcgagatgcagcgtgccggcgccgaatggggcctcaccttcaacatgggcggcgcggcggtcgccaactacgccaccatcctgcaggccgaccgggcctgagcgcagccgatgaacatcgcaagctggctccatcagaccgccctctgctggcccgaccggccggcggtgttcgaaggcgatcgcctgcacctgagctatgacggcctggcgggcgcggtatccgaccgcgcccgccacctggcgcgggtgcacggcatcgtcaagggcgaccgcgtggcgatcttcgccaagaatgcggccgaatatctcgaaaccctgcatgcctgctggtggatcggcgccgtcgcggtgccgatcaacggcaagctccacccggccgaggccgcctggatcgtgcgggattccggtgcaaaactcgccttcaccgacacgggtgacgtgctgggcgcctgcccgggcctcaccgaactcgccctcggcgcaccggtgccggcgggcggccagcgcacggcaccggtcgcctgcgaccggaccgatctggcctggctgttctacacctcaggcaccaccggccggcccaagggggtgatgctcacccacgacaatctccgccagatgacgctgtgctacgcgctcgacgtcgatcaggcgcgggccggcgaccacatgctttatgcggcccccatgtcgcatggggccgggctctatatgttcgcgcagatccgtgcgggtggcgcacatctggtgccggcctctcacgggttcgatccggcggagatcatggcactggcgcgcagccatggcgatctggtgttcttcgccgcccccaccatggtcaagcggctggtcaccgccgcgcgcgccgccggctatgacggcagcggcatccgcaccatcatctatggcggcggcccgatgtatgcggccgatatcgacgaggcggtggcggccttcgggccgcgcttcgtgcagatctacggccagggcgaatcgcccatgaccatctcggtcctgccgcgggcgctggtcgccgaccgcagccatccgaactggcaggccaggcgcgcctcggtcggcttcgcccatggcgcggtcgcggtcagcatccgcgatgccgatggccgggagctggcgccgggagagaccggcgagatctgcgtcgagggccccacggtcatgcgcggctactggaaccgccccgaggcgacggccgaaaccctgaaggatggctggctgcacaccggcgatctgggccatctggatgccgaggggttcctgcacctcaccgaccggtccaaggacgtcatcatctcgggcggcaccaatatctacccgcgcgaggtggaagaggccctgctgctgcaccccgcggtattcgaggtggcggtgatcggcgagcatgacgacgactggggcgagcgggtggtggccttcgtggtgaccgccggcaccgaggccgcagatgccgtcacgctcgacctctggtgccggcagcagatcgccgccttcaagcggccgaagcgctatgtcttcgtcgacgccctgcccaagaacaattacggcaaggtgctgaaaaccgacctgagggcgatggcggccgatcagccgccggcggtgcccgggctgaaccggccgacgaaccggtaaagcccggcggggtggaacaggcggacctgggtgatggtccgcgccccctgccgggtttcgcgatccaggatcagcagcgcatcgccgcgatccaggttaagcaagcgtgcgatcggggcatcggcaaggccggcgccgatcacatggactgcatccgaccacggtacctgttgcagcaaccaacggcccggcgcggtggtggagaaatccatctcccgcgccgccggcacggcctccagcatcaccagccggcgttccagcgccaccgctgccccgtcgatccggtgcagcccttccatccgcagcacctcggtgccggccggcaccggaaatgcgctgccctgggcctcgggcaggcgcagaacctcgcgggacagctgtacataggcgtagctgcgcccggcgcgcgccgcctccaccgcgaaatcctggatctccatcaccgtgcgctcgatccgcggccgggtgacgaaggatcccgcgcggcgccgccgctcgatcagcccggccgcagccaacgcggtcagggccttgctcacggtcatgcgcgagcaaccatagacctccatcagttcgtgttcggacgggatgcggtcccccggcttcagccggccatccagaatgccgccctctatgtcgccatagatgcgctgatggagcgaggcggcgggcgcgtctggcacggcggggcatcccgaaaccggtggcccgcggccggcgccgcgggatcggaataagcatagacaattgccccgccgcggcaagacgatcggatcagtcggccggcaacagacccttcagcgcatcggccgccttggtcggcgccacctcgtagacgtcgtagacggcgacccccgcggtcacgaagggatcggcggcgatgatccggtccagcgcctctcgcgccagaccggtcgccaggatgaagccgccgctgcgcggcacccgccggccggccagcacgaaggcgccggtggcgaaatgttcgcccacccagaccttgtgcgcctccagctcggcatccaccgcctcgagcggggctgtataggtcaacaacaggatgtacatcggcgcgcctcctggcctttgcggttcccggtcaccgccccttgcgtgtggttgcgcgggctggcttcacccccgcgcgaggtgcagcggtatccggctgccgattgtggcggggcgtgctgcggcgtgcaaacaatcggttgacatcatgtcgccacggtccgagagttgtccggacaaataacacatgcaggggatctgggatgagcttccgttggccgaacggcgcgcggctcgcgatgtcgatcgtcgtgaacgtcgaagagggtgcggagatgtcgatcgcgcgcggcgacaagggcccggagccggtcgacgagctgggcgtatcgctgaagattccgatccggaattacggcaacgaaagcaattacgactacggcatccgcgccggtgcgccgcgggtgctgaagctgctggaccgctacggcttcaaggtgaccttcacggcagccgccaccgcgctggaacaggcgccggaactggcaaaggcgatcgcagagggcggccacgaggcctgttcgcatggctggcgctggatccaccagttcagctatggcgaagagcgcgagcgggagttcgtgaagaaggcggttgcgagcatcgaggccaccaccggcacccgcccccatggctggctgtcgcgctacatgcacacccccttcctgcgcaagacgctggccgaggaaggcttcgtctatcacatggacgattacagcgacgacgtgccgcgctgggatgtggtggaaaccgcccggggtccgaagccgatcgtgatcatgccctatgcgctcgacaccaacgacatgaagttctggctggcgccgggctataccccgcagcagtggctggactatgcgatcgccactttcgagcagctgtacgaggaaggtgcggaggcgccgcggatgatgtcgctgggcctgcatctgcgcatcatcggccgcccgggccggatatgggcgctcgaccgcttcatggcccatgtggcgagccgccccgatgtctgggtgaccagccggctcgacatggcccgccacttcgccgccgaggttccgccgccggtctgaggtcggccgccacggtcacccgcttcgcccccgcagccatcggccgcatgcgcggccaagccgaaggaggccggccctcatgaccctcatcatccgtctgtcgcgctggtccgcctggatcgccggcatccttgtcctggcggccggcctgctgatcgccggcgacgtcatcgcccgcaacatctggtcgaccagccccttctacagcttcgaaatctcgcgctatctgttcggtgccacggtcgccttcgggctctctttcgcgctggtcgaacgcgcccatatccgtatcgacccgctggtcaagctgacccgcgggcggctgcggtcgctgatggacctcttcgccatcctcgccaccgtgccggtggccggcgccatcgcctggtatgcctgggacctgaccatccagagcgcggagctgggggctatctccaactcaccgctcggtcttcagcaatggatcccgcaggcgatctgggcggccggtatgacctggttcgcgctgatcgccgcagggctcgccgtgctcgccctcatcgccctcgtccgcggccgagatgccgaggtcggccgcattgccggcctgcccgatttcggcggcgaaggcgccgaggtcgcccatgatctcgacgccgcacgcggcgatcttcagatggaggccgcaagatgatcggcgtcgcaggcggttcgcttttgatccttctggcgctgggtctgccggtcggtgtcgccctcggcatcctggcggtgatcctgggcgatctctacggcttcctgtcgccgctgcccgcgctcggcgacatcatgtggggcgcctcgaccgactttctgctgacctcggtgccgatgttcatcctgatgggtgaactgctgctgcgctcgggcgtggccgctgaaacctatgacggcatcgacccctatgtcagccgggtgcccggcggcatcatgcacaccaacatcgcctcctgcgcgctgtttgccgccacttccggctcgtcggtcgcgaccgcggcgacgatcagcacgctggcggtgccgaacatgaaccggctgggttacaacccgccgctgttcctgggctcgctcgcagccggcggcacgctgggaatcctgatcccgccatcgatcaacatgatcctctatggcgtgctggcggacgtctcggtcggtgatctttacgccgcgggcatgctgcccgggctgctgatggcagcactgttctcaggtatcatcgccgtctcctgcctgatcaaccccgccctcgccggccggtcgaccggcaaccgccccacgctcaaggggctgctggggctgctgccgatcctggtgctgttcgcgctggtcgtgggctcgatctatgccgggctcgccacccccaccgaagccgcggcgctgggcctgctcggcgccttcgcaatcgccgctgcccgtcgcaggctggaccgcgccaccctgctcgccgccttcgaaggcaccgcgcgcaccacggccatggtcatgttcatcgtgctcgcggcctatttcctcaacttcgtcatggtcaatatcgggctgaccacggccgtcaccggcctgatcgccgatctcgacctgtcgccgttgatgatcctgggcgcgatcgtgctgctctatatgatcctcggctgcttcatggacacgctgtcgatgatgatcgcgaccacgccgatcatcgtgccgatcgtggttcaggccggcttcgatccgctgtggttcggcgtcgtcttcgtgatcctgatcgaagcggccctgatcacaccccccgtcggcatgaacctgttcatcgtccaggcggtgcgcggcggcgggccgttccgcgacgtggtcgcaggctccctgcccttcctcttcgtcatgatggcgatgatcgtgctgctgatcatctggcccgatctcgccctctggctgccggcggccttcaagggcgggtgaccatccgcccggccgtcgcctctcgtcaagcatcaggcccatcaagaacaacggaaaccgacaccatgacagggaaagccattgccgccggcgcgggggtctgcctcgtgctggccgccgggacggccgtcgcccaggatctgcccaagaccgacatcaccgtgatcggcaatctgggcatcaccacccagagccgccagatcgaggcgccgttctggacgaaggaactgcccgaggcctcgggcggggcgatctcggtcaacttcaagccctggaacgagctgggcctgaagggccctgaagtcttccggatcctgagccgcggccaggcactgatcgccaccgcccagctcggccatcatgccggcgatgcgccgatcaacgacggcaccgacctcgccggcctgtcgcccgacatggcgaccttccgcaaggtttccgaagccttccgcccggcgctgaacgatgccctgaacaagaagttcggcatcgaaatcctgaccatgcagtccttccagagccagatcctctactgccggagcgagatcaagggcctggcggatctgaagggcaagcgcatccgcacctcgggcgcctcgcagggcgatttcgtcagctatttcggcggctcgccggtcgacatggccttcggcgaggtgcagcaggcgctggcccagggcacgatcgattgcgcgatcaccggcacgctcggcggctacagcgccaagtggaacgagggcgcgcgctatctctacaccttgccgatcaattacggcgccggcgtcaccgccgccaatatcggcgactggaagaagctgcccgaaagcgtccagatcttcatcaccaccgaactcgacaaggccaatgagcggatgtggcagctgaacatggacgaagacgccatgggcatcgcctgcaacaccaccggcccctgcccgctgggggagccggccggcatgacccgcgtcgatccgggtgcggaggacgaagccctgcgccgcaaggcgctgatcgaggcggtgctgcccaaatgggccgcgcgctgcggtgccgactgcgtggcggactggaacgccaccgtcggtaaggtcgtcgacatgcaaatcaagtaaccagcggagccccctcatgaccgtcgcctccccgcccgccctgccgaccggtatcgtcgacgccttcgcgacacatgtggcgcgcacccgttacgaacatctgccgccgcttgccgtggccaaggccaagaccttcctgctcgacaccatcggcgtcgggctggccggcacctcgggcccccatttcgcccgcatctcccgggcggcagaggcctggggccggggcgaggaggcgacggtctggggcagcgggctgaaactgcccgccccctcggccgccatggtgaatgcctatctgatccattgcctggaatatgactgcgtgcatgaacgcgccgtcgtccacccgatggcaaccatcctgtcggccttcttcgcctgggccgaacgggccggcggccgcggccggccggtgaacggtcgccagcttttgacctcgcttgcggtcggcgtcgacatgtcggggctgctgggatccgccaccacggcgccgatccgcttcttccgcccggcggtcgccggcggcttcggcgcggtctcggccatcggcagtgccgcgggctttaccgccgcccaggtggccgatgcctacggcatccagtacgggcaatgcgccggcacgctgcaaccccatgccgaaggctcgggcctgctgccgctgcagatcggcttcaacgcccgcgccgccatcacctcggccgatctggtcgaggcgggtttcgacgggccgcatgacgtgctcaccggccagtacggctattacaacctgttcgaactcggccagtattcgcccgaggtcatccccgacgagctgggtcgggtctggcagatcgcccggctgtcgcataagcccttccccagcggccggctgacccatggcgcgctcgacgggctgcggcaggtgatggcggaaggcatcaccgccgccgatatcgcctcggtcgaaatccaggcgccgccgctggtgaagcggctggtcggccggcccgatctggacaatccgccggccaactacgccaagctctgcctgtccttcgtggccgccaccctgctgctgcgtggtcgggtcgacgtgcccgaattcgccggtgacaccgtgctgaacgaccccgaaatccatgcctatgcaaagcggatcagcgtggtcgacgacggcaatcccgatcagaacgcgctggccccgcagcgggtgatcgtccgcctggcatcgggcagcaccagggtgatcgacctgccggaagtctatggccatcccgatgccccgctcaccgatgccgagaaccgcgccaaattcgcccgctgctgcggctgggcggtgccgccggtgccggatgcccgccgcgccgagatcgagcgcatggtcgacgagatcgaagacgtcaccgatgtcggccagatcgcgaagctgatggtttcggaaggctgacccgaacgggctgaccaccgcctctcccgcggcgccggcagggctttgtaccgcatgctgcggtcgggcattgacggcgccgtttttcggaccataatttgtccggacatttaaagttgcacccttggcgcttcacccggcgccgcccccctgccgcttcaggcgcccttcgaaagacccgagacatggttgaccagaccaccgccgctgccgccgacaccgaggacggcgagatcctcgccacgatcgacaagtggctcgcccgcgatgtgcggccccatgtgctgaagctcgatcatgccgatgagtacccgcacgaaatcgtcgcccagatgaaggagcttggcctgttcggcgccaccattccggtcgaatatggcgggctgggcctgaacgcgacgacctatgcgaagatcgtcgagaccatcgccgagacctggatgtcgctgtcggggatcatcaacagccatctgatcatgtcggcctgcgtcgcccgccagggcacgcccgaacagaaggcgtactacctcccgaagtttgccaccggcgagctgcgcggcggcctggccctgaccgaacccgatgccggcaccgatcttcagggcatccgcacccgggcgaggcgcgatggcgaccactatatcgtcaacggcaccaagacctggatcaccaacggcatcgaaggctcgtgcttcgcgctgctggtcaagaccgaccccgaggcgaacccgcgccacaagggcatgtcgatgttcatcgccgagaagggccccggcttcacggtgtcgaagaagctggaaaagctgggctataagggcatcgattcggctgaactggtcttcgaggactaccgcatcccggccgaccggctgatcggcggtgtggaaggccagggcatgcaggcggcgctgggcgggctggagcttggccggatcaacatcgccgcgcgcggctgcggcctggccgccgcctcgctgaacgactcggtgcgctatgcccagatccgcaagaccttcggcaagccgatcgccgagcatcaggcgatccagctgaagctgggcgagatggcaacccgtctgcaggcggcacggctgctgacctatgatgccgcccgggcctatgaccgcggcgagcgctgcgacatggaagccggcatggccaagtatttcgcctcggaagccgccgtcgccaacagcctggaggcgatgcgcatccatggcggctatggctattccaaggaatacgatgtggagcgctatttccgcgacgcgccgctgatgtgcatcggcgagggcaccaacgagatccagcgcatgatcatcgccaagcagctgatcgcgcggaacccggcatgaccatcggcggcgatatccccaccgccgccatcccgaccggcccggccgcggacgacgaccgtccgctggccggcatccgggtgctggcgatcgagcagtacggggccggccccttcgccagcctctatctttccgacatgggcgccgaggtcatcaagatcgagcccacgcccgccgacgggcagaagggcggcgacagcgcccgccagagcggcccgcatttcctgggcgagaacgacagccagttcttccagaccttcaatctgggcaagcgcagcatcgcgctcgacctgaaatctcccgccggccgcgcggtgttcgaaagactggtcaaaaccgccgatgcggtgatgaacaatctgcgcggcgaccagcccgacaggctcggcatcacccatcaggcgctgaaggcggtcaagccgtcgatcgtctgcgcccatctgtcgggctatggccgcagcggcccgcgcgccgcctggccggcctatgactatctgatgcaggccgaagccgggttcatcgcgctcaccggcgatcccgaaggtggcggcacccgcatgggcctgtcggtggtcgattatctgaccgggctcaccaccgccttcgcgctgacatcggccctgttcggcgccatgcgcaccggccgtggccgcgatgtcgacgtcaccctctacgacgtcgccgtgcaccagctcacctatccggcgatctggtatctgaacgaaggcaccaccaccgggcgccggccgcgcggcggccatccggcggtcgtgccctgcgaacagtttccggtggcggatggcgcgatctacgtgatgtgcatgctgcccaaattctggcgcgcactctgcgagatcacaggcctgcccgatcttgccgccgatccgcgcttcgccgatgtcgccgcgcgtttccgcaaccgcgatgccctcgccgccatcctggatccggttttcgccacccggaccatggccgactgggtggccgccttcgccggccggctgccggcggcaccggtgctctcgctcgcccaagcgctggacaacccgttcctcgccgaacgcggcggcatccagaacgtcgaccatccggcaaagcccggcatgcgagtgctctccaacccgatccggctggatggtgcggtgatcagggcaaagccagggccgggcctcggtgccgataccgacgcgctgctgggcgagcttggctacgatccggccgccatcgcagccctcagggccgagggggccgtggcatgaagctcgaaggtatcaaggtcgtcgacctgtcgctgttcctgcccggcccttatctcaccatggtcatggccgatcacggcgccgaggtgatcaagattgagccgcctgcgggggagccgacccgcgacatcggcgccaaggccggtggcaccagcgtctggttccgcaacacccatcgcggcaagcgatgcgtcacgctcgacctcaagcatcccgacgacaaggcgcggctgttcgaaatgctggccgaggccgatgtgatcggtcgaggccttccgccccggcgtcgccacccgtctcggcatcgactacgaaacggtgcgggcgatcaacccgcgcatcgtctattgcgcgatctcggccttcggccagaccggccccgatcgcgaccgcccggcccatgacatcgcggtcgaggcgctggccggcgtgctcagcctcaatctgggtcaggacggcaagcccacccatccgcatatccccgtcgccgatgccaatgcggccctgctgggcctggccggcgtgctgatggcgctgctacggcggacgaccaccgggcgcggcgactacatcgacatggcgatgctggatgcgaccatggcctggctgcccaatgccaccggcgatctgttcgccaccggcaggccgccgatggtgaaggaacagcgccaatggggcggcggctcgttctatcagatctacgagactgccgacggccgccacattgtgctgggcggcagcgagcataaattcgtcgaaaccctgctcaaggcgctcggccgcgaggatctgatccccgccgcctccagcccgcccggccccgcccatgccgagaccacgacattcctgcgcagtgttttccgcacccgcagccgggccgattgggaggcctggttcgaaggccgcgacgtgtgtttcgcccccctgctcgacctggcggaggccttcgcccggccgcaggttcaggcccgcgagatgctgatccgcgatgcggacggcaatctgcatgtcggcacgccgatccgcttcctggacgaacccggccgcatcgataccagggtcccggtgcgggagcccctccccccgcgctgaccggccccggtcgcacgcagccggtccgggtccggctgcgtgtttcagcccggacggcggcgtgttgagagcgtcgcgccgccgcccgggctgcctttccgtcagggtttcatggcacgacaccattaacacccacgtaaccacctgcttcctaaactcagctacggccgcagaaacacaaccaggcggcgccgggcggggggtgcgggatgttcaagacatcgatttccgggctgttgaccagcatccagctcgccatgctggccggcctgctggcagccgcctcgatcctggcggccgatgcctggcgggatcgggccgcggccgaacgggtcgtggatgccgcccgcaccgaccgggcgctgttcgccggcgtgatcgacacccgcgcccagatcgcagccgtgcagaccgcgctgctcaccgaagacgccccccagaccacgatctcccgggtccgcgacaaggccgatgccgccgccgccggtgcagtggacttcgccggccggatgacgggcgaggacgcgcgcaagggcaccgaagccgtcacccgcgccatcgccgacatgcaggcgaaacgcaccgccatggacgcgctggccacccgcccgcgcgaccaaaggcagctggccgacagcgccgcctggcgggaatccgtctacggcgtggtgaacgccatgctggccctgtccgatcagatcggcgacgagctgcgcatgaccgatccggcgattgcggaactggtccagatccgccgtttcgcctggcagctgcgcgaccagttcggtggccaatgctccctgctgcgcccgctggtcgccaccagcacgcccatcccgcccgaaaccctgacgaaatgggcatcggggaccggtggctggcaggcggcactggccggcatcgactccctgctcgtccgtccgggcgcgccggcggcggtgatcgcccgggtcaacgccgcccgcgcccaggtgaccgacacccaggcacggatggacgcgctggtggcccgcttcgacggcagcggcaagccggccatggaggcgcgtgcctacaccgcgatgtgcaacggccccttcgatgccatcctcgcgatcagcacggcggcgctgaacgaggccgtggcgcttgcggaacaacgccagtcgaccgccaccgtcaatctcggcctcaccctggccggcctggcgctggctctggccctgtcggttctgggcctggtggtgatcgcccgccgcttccgtcggccaatgtcgaccctgatgaccgcggttggccggctgggcaggcgcgatttcgaaaccccggtccccgcgccgcgccatcccgatgaaatcggccggctcgccatcgcgctcgaagatctacgggtcagcgcccgcgaggccgagcggctggaagccgaagccgccgctgcccgcgcccgcgacatcgcccgcgccgaaaccgtccgcgatctcagccgcagtttcgagggagaggtgaccgcggcactcgccggcatcagccatgccggccacacgctcaggaacaccgccagccatatgcgtgcgctggccgatgccgccagcgaacgtgccaccaccggcgccggggccaccgccgaggcggcctccagcgtgcagaccgtggcggcggccaccgaggaactcgcggcctcgatctcggaaatcagcgcccgcgtccaggccagcgccaccggtgcacgagaggcggtggatcaggtggcggccaccggtcgcagcttcgatgcgctggtcgaagcggcgcggcggatcggcgacgtggtcggactgatcaccgatatcgccgcccagaccaatcttctggcgctcaatgccacgatcgaggcggcccgtgccggagaggccggcaagggcttcgcggtcgtcgcctcggaggtcaagaacctcgccaaccagacgtcgaaggcgaccgaggaaatcacggcactggtcgccgacatccagcgccgcaccggcgaggccgcggggtcgatggatcaggttcaggccgccatccgcagggtcgatcaggacagtgccgccatcgccgccgcggtcgaggaacagggtgcggccaccggcgaaatctcgggctcggtccagcaggtggcgaccgccaccggcgaggttcaggacatcatcgccgaggtcgcccggtcgagcggcgagaccggccgggccgcgaccgaggtcaccggctcggtcgaagaggtggtccacgaacaggaggtgctgcaacgggcggtgggcgatttcctcagccgcgtgcagcaggcctgatcacgagcgcgatcccgcccagcaccgccaccgacaccacgaccagatgccaggtgatcgcctcgcccagcagcaccgtgccgccgagcgccgcgatcaccggcaccgacagctggaccgaagccgcctgcgcggcgcccagtgccggcagcaccgcataccagacggcatagccgaggcccgaggccagggcgcccgaggcgaccgcgagtgccacgccctgaggatcgatctccatccgcagcagcgccggcaccagcagcagcaccgccagcggcaggctgcgcatgaaattgccggcggtggtcgccagaggatcgcggctccgccggccgatcagcgaatagacgccccaggcggcgccgctcgccagcatcagcgccgccgcaaccggatcgggcgcctgcgcaccctgatctggtatctgcgtcttgggcgccagcagcgccaccagcccgcccgcggccagcgcgatccccagccattgcagcggccgcagccgctcgccgcggatcagcccggccgcgatcatcgtcacctgcaccgccccgaacagcagcagcgcccctgaggcggcgggcaggccgacataggcgaaagagaaggccgccgcataggccgacagcgccgcggcccctgcccaggatcctggccacgggccgggtcggacgcccccgcccgtccgccggcccgccctgaggcagagccacagcatcaccgcgcctgcggccagccggaggccggtgaaggcggcgggatcgatcgcggtccggtccagcgcccagcggcagagtaccgaattggccgcgaaggcgatcattgccaccaccgtccagccgatgatgcgggggcggtcgcccgcgatcatggcagcgcgccgggcgtcggccgggatcctgccgatacacctcgatcatggcagagcacggcattcaacatcggcgaccctcccatatggttgcaccggggcccgaagcgggggcaggctgcggggatgccggcttgcgatgcggccgccatcgtggcacatcctggccacgccgtccgcccttccggtctcaggagccccccgatgcccgtccgcccgatcgtgatgtttcccgacccgcgcctcacctcgcccgcggccgaggtcaccagcttcgacgccgccctcgccgcgctggccgacgacctgctggacacgatgcgcgacgcccccggcatcggcatcaccgcgccgcatctgggccttctgcatcgcctggtggtgatcgaactgcccgatgacgcggaagccggggacgcggaagccggggacgcggaagccggggacgcggaagccggggacgcggaagccggcgacccggaaggcgtgcgcatctatgtcaacccgcgcatcacctggtcgtcggacgacaccgtgatccacgaagaaggcagcatctccatgcccggcgtcagcgaagaggtggaacgcccggcgcgcatccgcctcacctggcaggacctgacgggtgctgcacacgaggccgaggccgacggcctgctcgccatctgcctgcagcacgaaatcgaccagctggacggcatcttctggacccgccgcctgtccaagctccgccgcgaccggctgcacaagcgctatgaaaagatgaggaaggcgggcagccggtaacggcgagggatcaggccgccgccgccacccgtcagagatccggacgatcggccgactccgccacctccttctgggcagcaagagcggccaggcgcgccgaaagcgccgccgagaccgaggcataggccgtgctgcccagggtcagccgcagcggcggggcggcactttcggccgcagcgatcatcgcagccacggttcgggccgcatcgcccttcaccacgaaactgccatcgccgatcgcgcgccgcacatcgccggcgggtgtctgctcatagacatccaatgcatcggcgcgcacgaggttcgccccgaaattcgtcgccgtggggcccggttcggcgatgatgaaatcgatcccgaagggcttcacttcctgggcgaccgattcgatgaacccttcgatcccccatttggtggcgtgatagaggctgaagcagggataggcgatctgcccgccttcagacgagacctgcaggatgcgcccgccgccctggcgacggagatgcggcagggcagcgcggatcagatggatcgatccggcgaggttggtggcgatctgcaggtcgatctgcgcggtcgtcagctcttcggccgcgccgaacagaccataggccgcattgctgacgacgacgtcgatccgcttgtgccggcggaacgcatcgtcgatggcgccgtagatttccgacaccgcggtcagatcgagccgaacgacgtcgagacggtccccgtactgccgctgcaaatccgacagcagatccgcccggcgcgtggaggcgacgacactgtcgccctttgcaagaagctgccgtgccatgtcgaggccgagccctgaggatgccccggtgatgacccatgttttcgtcatgaggattacctttctggtggtcatctccaaggtagatcgggctgattggtgagataagattcccaggatgggatgacctggtgaggaaatttcacatatgatgcgccccagcctgaacgacctcgccgccttcgccgctgtggccggccaccacagctttcgcaaggccgccgatgccatgggggtgtcgcgctcggcgctcagccacacgatcagcgggctggagcggaagctgggcatccgcctgctcaaccgcaccacgcgcagcgtgtcgctgaccgcggccggtgcgcagctgctcgaacggctcgatccggttcttcaggatctcgaccaggcgctcgacgccctctcggatgtgcgtggggcaccgcggggtgtgctgcggatcaatgccaacaagagcggcgctgaattccttctgaaccaggtcgtcccgcgtttcctcgatctgcatcccgaggtcgagcttgatctggtctccgagggtcggctgatcgacatcgtcgagcacgggttcgatgccggcgtgcgccttctggaggccgtgccgcgggacatggtcgcggtgaaattcggcggcgacatccgcttcatcgcggttgcagccccgtcctatctccagaactgcgaaccgccccaaaccccggacgaccttcaggcccatgcctgcatccgccagcgcctgccgagcggaaagcgctaccggtgggagttctcaagacacggagccgaagtcaccatcgacgtcccgggcaccctcaccctcgacgacaatgatctcctggtacaggccgcggcggccggacacggcatagcctatgtcccggaacccgtcgcccgggcccgtctggcatcgggacagctggtgaccgtcctcgatccctggtgcccgccgatacccggtctcgcgctctactacccccgcaaccggcacatgccggcaacgcttcgggcgtttatcgatgtgatgaaaactgcgggtaaatcagggggttgaggccggggtggcgggtcatctcccgacccactgatcccaccccgccatcgccacgtctgccaccgcctccagctccgcccggccggcgccgtcacgggccaggatcgacatgccggtctggacggtctggatgaagcgggccagggcgtggatgtcggtagcgggtgggatgtcgcccatggtgacggccgtggcgaagcgggcctccaggcgctggagggtggcggcgcgggcgttctgcagcagctcgaccagggccgtgtgcgcttcgctgccgatggcggaaagcgccaccatgcagccatgggggatgtcggcgcggcagccggtcagggcggcggctgaatccgtcagcagggcctgcacggcatcgcgggccgtggcggcggccaggaagccgccccagaccaggtgttcataggtctcgcggtaatggtccaccgcctcggcatagagcgcctctttcgatccgaaggcggcgtaaaggctggtcgagccgatgcccatggccgcggtcaggtcggaaatcgaggtggcgtcatagcccttcatccagaacagccgggtcgcctcggccagggcggccttgcgatcgaacgcacgaggccgcccacggctgcggggtccggatgcgggcgcgggtgcggcggtggtggcggccgctggtgaggcgggacgatctgatttctgcatcgatcactttataaacccgttgactccccccggcaatcggtttaccgatttatgcatcgatcgatacataaatctgaacccgaccttgctcatccgagaggacaggacatgaactcccttgcaggcaggcgcgcgctggtcaccggcgcatcgcgcggcatcggcgccggcatcgcactggcgctggcggatgccggcgccgatgtggcgatcacctatgaacgctccgtcgatcgggcggctgcggtggtgggcgcgatcgaggccaagggccggcgcggcctcgccattcaggccgacagcgccgaccctgccgccgtgaagcgatcggtcgacgaggcggcattggggctcggcggcctcgacatcctggtcaacaatgccggcatcgccgatttcggcccgctcgtcgaccttcccctcgaacggatcgatgccctgctgaacgtgaatgtacgggcggtggtgctggccgcgcaggccgccatcccgcatctgggccgtggcggccgcatcatcagcatcggatcatcgctcggcgtacaggtgcccgccgcggggttgacgatgtacgcgctgaccaagtcggcgctggtgtcgttcacccgcggtctggcgcgcgatctggggccacaggggatcaccgtcaatctggtccagccgggcccgatcgataccgacatgaaccccgccgatagcgagatggcgcagatgatcatcccgcacacgccgctcggccgctatggccggccggaagacatcgctgccgcggtcaccttcctggccgggccgtccgccagcttcatgaccggctcggccatgacggtggacggcggatacaacgcctgagccggcaaaacatctcaaccgttccgtccggccgggtgcgcaggcaggctcaccttgtaaaggagagcccgctcccgcgatcacatcctctggaatgcccatgagcggagctacgatagaaaaatcggataaaaccggcacagtctaaaaactggaataagaggtccggtcagctaagcccagcttcgtctcaacgtgaaagagatatatcagcaagacggatgggcgtatggagtaggccacgtgcagtaaattagcatacgaatggctcactccggacattgagcacggccaatgctgctgcagcgcagcttctgctaagcggacgttaggaaaatgtctatcgtctcttgacctctcaagtgctggtcaccatctccgtggcaccggcctttcgtagctcagctggagagagcaccggtgttggaaaccggaggtcgcaggttcgagtcctgccgggagatcagaggggcgccccaggcgcccctcgccatttcggccttgaggcggcttttttaccccaaaacgatcgtcccccgccccatcacctggcccaggctgttctggatgaccaccggctttctgggctttctcgtcatcgcccggctggcccgtatcgaggacggtctggccggggacgactgtctttcgggcatcggcctcgccctcggcgcagcctgccccgcatccgcaccgcgctgatcgcgattctgcagtttctctacccggtcacggccctggtcgtcgactgtgtggccttcgacacgatgctggatctgcatcaggcactgggcggggccgccatcatgctcgcgatcctgggcaccagcctcaactggtcgccggcgacgctttttcgccgggcagcccaccaccagaaaaaggcttaagcgccgcatagatgcacgactggacgggggtgtcgatgccggtcgcaagaccggcgcgatggatggagcccgcaatccagtccacttccagccggcggccgcgctccagatcgaccagcagcaccggcttcagcgccggtgacttgccggccaggaccgcggcggtgcgggcctccagatcatccggcaccgccaccccccgtgcgcgtgccacagtccggcacctctggcgacccgctcagcagaccatgcgggccttcgccgccgcggcacattccgcccgggcttcagcctcgttgcgatcgcggccgaagccgacaccaatcgccctcgcccccgcctcgtcaccgatttcgacataggcggcgaaccccgccgccgtaccgtcgatgcggcgggcatgggcctcgccgcgcgtcaccgtccaggcggcaccgggccggttgggggtgggcatggcaccaccggtatccgccatataggcatccgtgaaggcggcccagatttcggcggcggcgagttcgcggccggtattgtcggccagttgctgcagacggcgggcgaaatcgatctgcacgaagcgcggcaggtccagcccctgagtgtgctgcagcacccagctggcgccagccttgcccgactggccgttcacccggatcaccgcctcgtaggaccggcccagatcggccggatcgatcggcagatagggcagatcccagatgccggtattgcgccgttcccagtcggcgaagcccttgcggatggcatcctgatgcgagccggaaaaggcggtgaagaccagctcgccggcataggggtggcgcggatggaccggcaggccggtcgcctcggtcgccgcacgcacgctggcatcgatgtccgagaaatccagccccggcgcgacgccctgggtgtagaggttgagcgcgagcgtcaccagatcgacattgccggtgcgctcgccattgccgaacaggcagccctccacccgctccgcgccggccatcactgccagttcggccgcggcaacgccggtgccacgatcattgtgcgggtgcacgctgatcaccaccgcgtcccgccgggggatggtgcgacagacatgctcgatccggtcggcatagacattgggtgtcgagacctcgaccgtggccggcaggttgatgatcatctttgcttcgggcgtcggccgaaccagatcgatcaccgcggcacagacctcgatcgcgaaatcgggctcggtggcgctgaaggtttcgggcgagtactgatatgtccactgcgtgcccggccggcgcgccatttcggccaggatctgccgcgtgccctccaccgccagggccttcacctcggcccggccgccattgaagaccatccgccggaattccggcgcgatggcgttgtagagatgcacgcaggcccgcgatacgccgtccagcgcttcgaagctgcgggcgatcagatcggggcgcgactgggtcagcacctgaatggtgacgtcgtcggggatcagccgctcgtcgatcagagtccggacaaagcggaaatcggtgtccgaggccgccggaaacgccacctcgatctccttgaagccgatcgcgaccagatgccggaacagcttcagcttggccggcacgtccatggggttcatcagcgcctgattgccgtcgcggaggtcggtggacagccagcgcggcgccgcggtgatgctgcgcgagggccattgccggtcggccatgtctggcatggttgcggcggggcggtatttcgtctgcggggtggtcaacatgaagaaagctctcgtctctgcacgacatatgggtgcggcgggcccttggccgccggagatggccgtcattcggatgcgggcgatcggcgtcagctgcaccggccgccggcgctaagtcgacgtgcgagatcgaaccgggccagataatcccgggcattgacatgcagggagtggagacgaggtcgcaacgcgccaccggcacaggctggcggcgtggatatggcggtagacatggaggagatgacttcagacgacggacagatgctggatcacttcggccggcagacatgccggatcacccgacctctcaggaggccgggcggcgaagtcgaagcaggttggccggcagcagggctgcgaaggatgcggtcgtcatctgtgcagcatggccgccggtgcaaccgcatgtcaagtcatccgtcaacgaccctgacgaaaggcggcagtggtcattccgggcgtcgggcgcggtctgaaggaaagcgggcgatttccgtgtgatccggcgccacctcgtggccgagaaacccccggccgcgatattccagccaggcatgggcggcgatcccgccgctttcggtatcacgcttcacgccatagacgatctcgaccggcacgccgcggcgtctgagcatgctctgcccggcaagcgcctgaggcaggcaaaccgccttgaacggcaccttgcgcgccgccactgccaccagccggccgatgcgccaggactggcgccagtccggatccgcccgcagcacctccagatcggtggtgtcgggcggcatcagccgggcgccctcgggccggcgcgatgaccaggcggccagccggcgaaacggaatcagcttcaccgatgtcaccgccagcgccaggcaaaaggccgcttcgatcaccagcagacgctggatccagatatcgccccgaggcggcggcggccgggtggcagggacggcggaagcggcaggctcggtggtcatgcggagggggtaccggaagcagacatggaacggacgccttcatcatagcggcaggcagggacagcgccaagccgcgcgcggacccgttccggttgcgggatcacagtcttggccacttggtggaagacaaggggatactttcgcgatattttgcgcacatgcgcgatttctgtcgcaaatcggcaattactaaatacaccttaaatatatactgtgtttcgggtgtattttagataaatgaatgaagcaaccagatgaccacgaccaccaacgacgctgccaccgatcacaaaagcccggacacggtcctgccgatggggaggccgatggctcatgccgtcaacggtctcttgcgaagccttgccgcactgtcaggtgcggaacaggcggtccttctgctgatgcaggccgacgggtcggtccgacggttgggcaaggcggttccgatcccgggcatcccggggccgatctttcagttgccggactgggtagcgcccaacgcgggcgcgcggccggtggcgatcggaaccaatagccgcccggcaacgctcgggctgccggcagccatggtcgacgtggtcctggtgcttgattccggtgatctgcgcgtcgtgctcggctggtcgggcatgcctgatgccgccgcccgcacgcgggccctgaccgcctggtcggatatcgccccggcgctggacgacgtggtcggccagtatcgccgccatgatgccgaaatggtcaggcgcgtggccatggcgcgggtcgaagccgatgtcgaccgcctggcagagacggtggcggcggcgaggcgtctgttcctggcacggatgagccatgaattacgcacgccattgaacgcgatcatcggcttctcggaactgatccggacgcgcgccctggggccgcaggcaatggaccgctatcttcgctatgtcgacgacattcatgtcagcggccgggaaatgctccggctggtcgacgatctgctcgacctcgcccgggtcgaaggccatgcccagcccatcgcccctgccctgcaggacctgcccgccctgctccacggcccgctcgacatcattcgccagcgcgccgaacgggccggtctgtctttacagacggatatccccgccggcatgccgcccctgcgcgccgatggcgagattctgaaacaggccatgctgcgcctgctcgacgacgccctgcatgcctgccgcgccggcggcggcatccggctgcgggcgaaaacccgagaggacggatcagggcatatcgacgtggaaaccgatggccggctcacggtcatgctccgcgccgacaccatggcgacggccgatgcccatgacgtcgatcccgcgatccgccaggccgacagcacgggggtcaatctgccgctggtggcggaagcgatcgagcggcatggcggccggatgaccgtcagtcccggcgacatgctcacccggattcagattgccctgcccggcctcgagacctgagcagccgggcggcgatgatgttcagatgtcagaaccgccgcggcgtgcggtaacgcaggctgcgggatctttcgcgccgcatggatcgccggcgcgaggtcaggcgcgcttcaggcggctcggcagtttgaccgcgacgctcgacaccgccaccgacggtttcgagggcttcagcaccaggccgcggccggaagcctcgacgttggcttctggatagacggcgagcacgtccttcagcacttccttcaggcggaaggccagaacccggtggccgctctcgctgccgaaatgatccgacagcgcatgccagggcacggtgatctcgcgcttcagcgcatgcagccgataggtcagccagacatagagatcgagggcgaggctcgaatgcttcagccgggcgatcgcctcttccgacagcggcaccgagtgttccatcagatgctcgaagaaggcttcggagagcttcacatgccgcacccattcaccgccggtgcggaacaggtcctcggcatcgctgtcatcgcgccacagatccatgccgtcgacgatccgctgatcggccagtcgcgcctcggcgctgccgcgttcgaagcgcatggtgaactcacaccgggcgatgcgtagtgcctgctcgcgaaccggcgcataggaaccgcgcggaccgcccgaggtcgacaggcccatcttgcgcagccagctggccatggtcggccccagatcgaccacctggctctggctgcgcaccgcctcggtctggaaatagatcatgatcagccgcgccttggtgccatagggcacgccgatgtcgacgatcttgtccttgagcggcaggatgccggggcggatgatcagctgataggcgccgttgcggcggacccagggctccagcggattcttcggctcacgatgcggcagcgctgcctgggcgaaacccgaatggagataattgatcgtctcgttctcgagcgacatcatctcgtgggcccagcgcacccgccgccgctcggcggccgaatccgccgtcgccatgacctgttcaaggccgtgaagcatgagctgctgatgcacgtccgccatatcgacctccgggctcacgcaccgggcgccatgctcctcacatggtcgtgccccgcgcatggtttcggccggcccctgccgaaggggcgacccgttcatgcctgatccgtcacgatccgactttacacaggacgggccgccggacggaagtccgtcaggcccccgcaacggcgccgcaccacgaatccgttacaagttcagcgatgctgccgcgccccgccgtcggatgatgacgcgaggatgaccaccgtttcaagttcagcgttgttgccgcatcgtcgcctccacctgtcgttcccgagctgtcgttgccccacagatgacggatatcctcggttttccacgctgaactcgtaacgttcggggggggtctgtcggccggctttcgctgaaaacgcaacgtatcggcgctgatctcgatacggcgcgggcccggctttacgctgaactcgaatcacctgccccggttatccacgctgaactcgataccccttcctatagagagtcccctatagatctttcttaccgatagggtgacgccgcatggtacatgccatcagggtcctgacgcctcccgccccatctcaacgacctcggacaaaggtctgtgatgccagccaaaacgggagacctgcatcaacccctccccccgcatcccaagccatcacccggcagtcgggtaccgggtttcgtccacagccgatcgccgatttcgacgctgaagtcgatacgccgtaccacgtcgtgacgcggtcgtcttcacgctgaattggtaacgcccggtcccctcccctcccctgcggcccgcagccgaagcgttacgagttcagcgtcgggaagcacgggattctgcgggactccggctcttgcggcacagctctcgctgattttgaaacgcccgccgcccgatcttcaggcatcgaccagattgtcggactcggacgctgaattggtaacgcccggcctgcgaccgatgggcgcggccacatcaggaatcaggtcaaccatcaacttcgcgattgatgcgttgatggcggcgtgcgatgctgtcggccgaacggtaacggggaccgcgccccctcgagaccggcttccatcccgtcacgctccagccggccgccggctggccatcatccgatccggaaaggctccccttatgaggctgtcccgatgaacggcgaacgcatgcgcgaacttcgccagcagctgcgcttcagccaggccgacctgaaggaagccctgaaccagatgcttagtcgcagctatgacaagcccaagatttcgcgctgggaaaacggccgcgatccgatcccggccgatgtctcgatggcgctgaaccgcctggtcgaaggcaaggggcgcgaggcgcggaccattgttttcgccaatcagaagggtggggtgggcaaaaccaccagtgcgctgaacctggcctatgctctcagccggggcgatcaccgggtgctgctggtcgatatggaccctcaggccaccgccacagtcgcccttctggccgacggcgctgtcgaagcctatcgccagcgccggaccatggcgcaggtcatcctgggcgatgtgccgatcgccgaggtcatcatcaaggccggcgaagaaatcatacccgaccgggcgccgctctgtgatcttgccgccagccatatcgatctggccgagaccgatggccggcgcgaacccggcttcgacatcaccctgcgcgaagcgctggagcaggtgcgcgaccgctatgacttcatcgtcatcgatgcgccgcccaatctgggcatgctgacctggatgtcgctggcggccgccgacgacgtgatgatcccggtgcgcaccgaaccctacgataccatgggcgtcggccttattctcggcaccatcaacaaggtgcagcggcgactgaacccggccctccggctggccggcatcctgcccacccagtacgggcggcggaaatcggtcgaccgcgaagtgctggcccatctggtccaggcgatgggcgatatcgccccggtgctggagcccgtgccgaacagcgccgtctttggccatgccgcccgcaacggccgcatcgccctcgaagcgtcgccatccagtgccgcaccctcggtctatctgcgactggccgccggcatcatcggcgacacccccctgccccgcgctgatgtcgatgtcagctatgccggcattgatgaggacgaggtctgatggctccgcgacgcaaggccccctcccccattctcggcgccgtgcgcgagatgatcgccgatgcctccgacacgctggtgaccgagaacagtcggttcaagcacactttcgaagtggcgatcgacaagatcagcccggacccggatcagccgcgcaagcatatcgacgacgaggcgatcgccgagctggcccgcaccatggaggagcacggccagctgcagccgatcctggtgcggcgcgatccggctgaccggcgccattacgtcatcgtcgctggtgagcgtcgctaccgcgccgcccggctgaatggctggcccacgctgctcgccatcgagcatgatgccgatcctgaaatcgcggcgctgatcgaaaacctgcagcgcgtcgacctgtcgccggtggacgaggcacgggggcttgcccgcctgatcgaaggccgcggctggagccaggccgaggcggctggcgtcctgggcaaggccaagagcgagatcagtggcgtgctccggatcctcaccttgccggatgatctgctcgatgcggttctgacgtcagaactcaccctgcccaagaatgtactggtcgaactggctcgcatcgagaccccggccgtccgtgaccggctggtcgccctcgccttcgacggcaagctgacggtccgcgccctccgcgccgcccgggccgaggatgacggcaagccgccaaggctgcccgagcacgacgctgaagttgaaacggccgccccgcgcacggcgccgggcaagctgtcgctgcggcagctcgatcgtctggcccttgcccttgaagccgccgcccatcgcggcacgcccctgagcgctgccgagcgtgagcgtctcgaaatcgtccagcatcatatcgaggccctgctcagcggaagctgacgcagagcggcgacgctgaagttgaaacggcagggccttcgggccctgccgtttgtcgttgcggtgtctcgcttccggatctcattccaggctggaccggccgcgtggatgcctcccttgcatcagccgatgcgtttggtcataaagacccgcgagaacccgttatcgatccggcgcccggtctcgacatagccgtggcgcgtatagatctcgacattccgtgccatcagcacatgggtgtagagccggacctcccgaagcttcagctccgccgcccgggcttctgtgaaggcgagcagctgacggccgagaccggtgccctgggccgagggcgccactgcgatgctgtgcaggaggagatggtcggtgtctgggatcaggatgaccaagccaaccggagccggcccggttccgaccgccggaccggtatcttccgccagccagacctcgatatccggatcggcgagcagggcagggacatcgtcgcccatcggcccgggctctcgcccgatcaccgggatccagggggcgtaggcggccgtcgtgatatcgatgatcgctgcggcgtcgtgaagcgtcgcccggcggaacgccggcgctggtggctggtggcacgacacccgggggccggccccggtgccgtccggcaggtcgatggtcatcatgtccgtcctcggcagcgccgtcctgatctggaaagccgggcaggggcgggcgatgcgatcacccggccgctacgtcatcatagaaccaatcggggcccggcttcctgcgtcaaccggcttcctgcgtcaaactgcccgggatctgcggtacgggcgggccacgctgaacttgtaacgccgggccgatgaaacaccgggtttggcgtatcagcttcagcgacgcattccgcatggccaccggcggcgctgaagacgatacggcggcgctgcgttctgatgtcagaatggtaacgctgaacgaacggcgagggcaggccatgaccgatggcatccgataaggcgttgcgttacgagttcagcgttggaaagaaggctgtagggtctgaaagggtgtttgcaaacagagctgctgggatccgccccgggcatctccgcgccctgaaacaggacatcagggcccgataatgatcaaggcgacggtctgccgtatcaaactcagcgcctggcgttacgagttcagcgttgccgaagagcgcggttatgggtcgcgggtcttgacgtcgacggccgggagccggagagtgacggcgcgtgctgcccatcaaaagccgagcccttgatgtccctgccccatgccctgcttacctcgctgctggagcggccctgttccgggtcggaactggccggccggttcgaccgctcgatcggctatttctggcaggcaagccatcagcagatctaccgggaactctcgcggctggaggcggggggattgatcgaggcgctggaacccgaggcgagccgtggccggccgcgggcctaccgggtgctgcccgccggacgcgccgagcttgcacgctgggtggatgaggtgtcggagccgaggccgcttagggatgaattgatggtgcgcctgcgcgctgccgcggttctgggcaccaccggccttgcggaggacctccggagccggttgcagcggcaccgcgacatgctggcccgctatcgcgagatcgaggcccgggacttcacgccgccgccggccacgcaggatgcccgccttcgccatctggtgctgaaggcgggcatccggcacgagagaaactggattgacctctgtgtcgatgcgctggagattctgtcggcggaataacccgccgacagcgcctgtgcgcggcggggcccggggcgcggatcagggtgcagaggggccatggggctccgaagaagggccgtgggtcaggtcttggccttgaatgccggcaggctgccgcccacgcgcgccgccatgcgggcacccagcgcctgcaggccgctcatcggccggaccatgacctcgaaatcccggatcagcccgtcttcatcgaaacggatcatgtcgatgcccttcaggctgcggccgtcgactgtggccgaaaattccagtaccacatccagcccatcatccgacacgaagctgcggtgataggtgaaatcctcgaagacctcgatgacattgctcagcgccagcaccagcgcctcggcagaggcataggcgttatgggccatgggggagcggaaaaccgcctccggatgggcaatctcgcgcaggcggccgagatcatgagcctccatcatctgatgccagagctgaagcgaggctttgacggcgggggcggcggcttcggggatgtacagagtggtcacggcgcgtttcctcgtatcggtcttgttgggtaagttctgacgtcagaacgtcgcggcgaggcgtgtgccctggtcgatggcgcgcttggcgtcgagttcgagggccagatcggcaccgccgatcagatgaaccgtgcagccggccgcctccagcgccgcggccaggctgcgctccggctcctgtccggcgcagatcaccacgctgtcggcagggatgacccgggtctcgccgcccgatgtcaccaccagcccgtcatcgtcgatccgctcataggtgacgccgccggtcatggtcacgccgcgggcctgcagggccgcacggtggatccagccggtggtcttgccgagcccggcgcccggccggccggccttgcgctggagcagctgcacctggcgtacggcggggcggggggccggcttgcccagcccgcccggcgtcgcggggttggtgtccacgccccagtcacgggcaaaatcttcgatgctgtcggtccctgtgccatcgggtcctgtgccatcgggtccgtggccttcgccatgggtcagcagctcggcgacgtcgaagccgatgccgccggctccgatgatcgccacccgatcccccaccggcttgcggtcgcgtagcacatccagatagcccagcaccttcggatggtcgcgcccggcaatctcgggcgcgcgcggcaccacgccggtcgccaggatcacggcgtcgaaaccgccgacggccagctcctccgccgtcacccgatggccggaccgcagcgccactcccgtcacctcgatccgcttgcggaaatagcgcagcgtctcgtggaactcctccttgcccgggatagttttggccaagttgaactggccgccgatctggtcgtcggcttcgaacagcgtcacctgatggccgcgttccgcggcggtggtggcgaaggcgagtccggccgggccggcgccgaccacggccagccgcttcggcgccgcggtcggcgcaatcaccagctcggtctcgttgcaggcccgcggattgaccaggcaggaggtgatcttgccaccgaaagtatggtccaggcaggcttggttgcagccgatacaggtgttgatttcatcggcgcggccggtgcgggccttgcgcacgaaatcggcatcggccaggaaggggcgggccatcgacaccatgtcgcaggccccttcggccagcagtcgttcggccagctcaggcgtgttgatccggttggtcgccaccaggggcaggccgaccatgcccttcagccgctgcgtcacccaggcgaaggcgccgcgcggcacccgggtcgcgatggtcggcacccgcgcctcgtgccagccgatgccggtgttgatgatggtggcgccggccgcctcgatggcacgggccaggatcgccacctcctcgaaggtcgatccgccctccaccagatccagcatcgacagacggtagatgatgatgaagtcggggccgagcttttcccgcacccgcctgacgatctcgaccgggaagcggatacggttctcgtaaggcccgccccactcgtcgtcgcggtggttggtgcgcgcggcgatgaactcgttgatcagatagccttccgatcccatgatctcgacgccgtcatagccggcctcgcgggcgagggcggcgcagcgcacgaaatccgcgatcgtctcctccacctctgcaccagtcagcgcatgggggcgggcagggttgatcggcgcgcgaaccgcactcggcgccaccagatcaggatgataggcataccggccgaaatgcaggatctgcatggcgatgcggccgccttcggcatgcaccgcgtcggtcacgatccggtggcggcgggcctcgtcggtggtggtcagcatcgccccgccgggcagcggccggccccgttcattgggtgcgatgccgccggtcacgatcagccccacttcgccgcgcgcccgttcggcatagaaggcggccatgcgctcaaagccatgcggcgcctcttccaggcccagatgcatcgagcccatcagcacccggttgggcagggtcacgaagcccagatccagcggccgggtgagggcggggaaggcggatgagaggggagggaagggtggggtaggggagagtggggtgggattggacagatcgacggtcatcctcagcgcgctccggcttttatgcaaccagttgcatgaactctagccggagccggagggtggcgcaactggttgcatggcgcgctgccggtcagccctcgtggagcatggcctggaagctgtccagatccggtgcctgcggcttccagtccgccggaacttccggcagcagctgcgacggcgtcaggccgaaattatggacatactggtcgatatgggtggcggtgatcagctggccgatctggtccatcaccgtggccttgccggtctgggcggggttctgtgccgtcaccgggttgttgtcggtgaaggggggccagtcgctccaggcggggtcggatttcagcgtatagccctgggcatcggtcgtgaccttgccccaggtgaaatgcccccaattggacgagaaatccgctgcaccgaacatgttgtgcgtgatgttggcataggtgatgtcgcggatccggcgctccatgtaatgcaccagcaggtcgaccgtgtagccgacgctgacggtgcccgagcccagcatgccgaagatgctgggataattgccggccttgtccttgggctggatcaccgtcggcagcatgttccaggcgcgcggcaccacgtcgtgcatgtttacaagatcggtggcgtcgggatagcccgcggcgaacaggtccaaccaggcctggttgcccggggtggcaccggccgagggcaggaggttgatggtgccccagccgcttttggtgggatccggatagagatagaaggcgagggtgggggagagcgcgccggccaggctgtggccggtgaaccagagcgtggcgctgctgtcggccttggatgccaggaagctttgcagcgagccctgtttcggatcggtcatgcccaaaagtgcgctgatgccggtggcggtaccagccgagatctgcggcgtgcttgccggcagcacctcgtgtcgcttttcggtgaacgggatcgccggcggccaggtcgaggtggtgcgggcgtagacgtcgaagtcttcgtcgatccagtccatgacgtttgcggcattggtcgccgcgatcgccaccacataggtgttgagcgacgggctccagccgacatacatcgaattcgtggcgtagagcgacaggatcttcgagccgtgcttgagcggcgccacccagacgcagggcccccagaccacctgccagtcaccgcccgccagctggctgttcatggtcgggaaaaagcccggccaggccgggccctgatagttggcgaaggcgccgtcgctcgacagatcctgcagcgtgccgccattcagcccggccgccatataggcggtcagctcggtgttgtagcccgaggtcgtcgccttgatatcggcgacggcattcgatgccagactgagtgagaacaccgtctggttgagatcataggccatggatgtcttccccccaaggcgtcctctgccctgaaacggcggaccattttgcaaaggacatgtgtagaccgggtgattttatcacgcgatcgcacgacgggaagttgcaggttgaggaaattcaacgattgttgagtgtcagccgctgcgtgacgttccgaagctgcgccgccagtcgctgggagtcaccccggtcacctgccggaagcgttggcggaaggtgacggcactgtcgaaaccggcttcggtggcgacccgttcgatcgaccacgcggtggtttccagcagcagctgggcgcgacggatgcgagcggtcagcagccattgcaggggggtggtgccggtttcggcacgaaagcgacgcgcgaaggtgcgcgggctcatccccgcgcgggccgcaaggcgctccaccttcagccgctggtccagattgacgcgcatccagtccagcaggggggccaggccggcggcggcgggcgggtcgtcctggatgaactgggcctgaccgccggcacgttccagcggcaccaccgccgccctggcggtgcgggcggcgacccgggcgccgaagtcgcgccggatcatgtgcaggcagaggtccagccccgccgccgccccggccgaggtcagcacatcgccttcgtcgacatagagcacggccggatcgaccgccacctcggggtacatccgggccagcagccccgccgcctgccaatgggtggtcgcgcgccggccgtcgagcagtccggcggcggcgagcacgaaggcgccggtgcagatcgacgcgatccgcgcgccgcggtgccgagcccgggccagcgtcgccagaatggccggatcggctgggctgcgcggctcggccatgcccggcacgatcacggtggccgcgtcgccgacggaggccagagcctgcggcacccttagaccatagccctctgccgccacctcggcatggggggctgcgaccgtgatccgatagggccgcgtgccgtcgtccagccgcgcgcgggcgaaggtctccaccgccgtcgcaaggtcgaaaggcagcacgccgtcgaaggcgagcacggcaaggtgatggggcggcatggcggctccggttgcagcctgtcgtctatggcggaaactcatcgatctttgtcattcctgccactggctgcaagcctgcagatggcggcaccctgccgcagtcgatcattgggagggaagggacaggcatgaccgccttgcagggattgagacgggccgcgttggcggaggggacgacgctggttctgctggtgctggttgcggtgccgctgaagcatctggcaggctggccgctggcggtacaggtgatgggcccggttcacggcctggcctttcttacctggacctgggcgctgatcgcttcggcgccggtggcaggctggcggccgctggaactggcgcagctgctgggcggcgcggtcgtgcccttcggtgccctgatcaacgaccggctgatccggcgccgggcggcggagatcgccgcatgaccccgctgctgctgctgaaggccatccatctgatggcggcgattctgtggaccggtggcatgctggttctggccctggggctgtgctgcggccgcccggccgaaccgctgatcacccgattgcgcgcctgggaccaggccatcaccgtgccggcgatggtggtggtctgggcggcgggtatcgccatcgccagcctggggggctggttccccgatggctggctgctggtcaagctggtggcggtgatggttctgtcgggcctgcacggcctgctggccggcaccttgcggcggatgctggtcgaccgggcccatctgccgcccggccttgcccgccatgccgccccggccgtcgtgatctgcatcgccgtcatcgtcctgatggccgtgcttaagcctctttagctgcggatgcgccggcagggcagggggccaggctggcgcgcatgatttcgaccaccgccgcatgggcggtggcatcgtccacggccggcggctgcggatcacgcaggcggtgcatcgccatccaggccgccatctccaccagggcgcgggcgcgggcatgggtggcggggcccggttcggcctcgccggccgccagggcggcgaaacgggtgaagtcgcggaaatagcggctgcgcaattcggtaccgtagaaggcggccacctcggggatttccgccgcgcagcgatccagcagccagatcagccgacgatgggtggcaagcagttccagcatctcgatcgccaccgcgcggatctcgtccgggccggcatggccgccggcaagggcggcgtccagagccggccgatgcacgcgtgccggcgccgccgcgaccagggaggcggcggccgaagccaggccctgcgcctcgaaccggtcggtgcccgctggcgtcaggccctgcgcctcggccagtgccagttcgaacagggcttccttgcccgagacatagctgtagagcgcccccgccgataacccggcctcgcgcgccacatcggccatctgggtcaggcggtagccctgacgggtgaaaacggtcagcgccgccgcggcgatgtcctcaagacgtcctggcttcttcaggcgcatcgcgtcgccagacgggtcatggaggcatacgccattttaattgaatcgttcatttaaaaatgatacacgcaaaggatcagccatacaaggtgacaccatggccggacccgccctcggacgttcgcgcgcgatcgatcacctgcgcaatcttgtgatccttggcctgatcctgtttcacaccgcccggctgttcgacaccgagccatggcatataaaggatgccggccgctacgccgcggccgatgtgttgatcggggtgttcaatatcgggcagatgccgctgctgttcttcctggccggcatcaccgccatgcacagtctggcggcgcgcgaggccgggcgttacgtgcgcgaacgtctgcagcgcctgggcctgccgctggtcgcgggcatcctgctggtggtgccgccgcaggtctatgtcgagcgtctggccgccgggctcgacggtcgggcgagcccgatcgaccttgcccccggtaccggctttctcgatttctacccgggcttcttcgactgctgctatccggcggccaatttcagctggcaccatctctggttcctggcctatctgctggtctatgccctggtgctgctgccggtcttcgtgatcgcccgccggcccgggccgcgggcgctgctggagcgggccggcgcgcgggtcgcggcggcagggccggctgcattgcttgcccccggcctgccggtcctgctgggcggctggttcgcgctgtcgccggcgctgggggcagcagccgaacgccattgtcgcctgcttctgatcatagccgcggttgcgaccgcactggcggtgacggcctggatgaccggggcgctgccggtgccggtcctgcgccggtcgctgcgtgtggccggcgaatgggccaccatcctcggcctgctcggctgggccgggcggcggctggcggcaccgatccccggcctcagcgacgtcacgcgcttcgcctttcccttctacatcgtccatcagacggtgatcgtggtgtcgggctatctgctgctcggctggtccggacagccgctggtgaaatatctggtcatcgtcctggtgtcgggcctggtctcctgggggctcgcccgggcgcttgccgccaccgcgctcacccgtctgctgttcgggatcaaaagcgaacggcccgggatgaccccgggccgctcgcagacgtcacgatcgatataggcccggcgcctaccagcgatagcgcagcgacagggtaccgccgaccgactggcgttcttccgagagttccgaatcgacgctcagctgcaggtcgagatcctcgtccaggcgatactgcacgccggccctgagcacagcggcatcttccggcacctcgacatcgctgccctggaagctgaccccgggcagctccgccagatggcgggtgatgtcgcgctcgggccggaattcgtgcttccagccggcgcggaagaagggttcgatccggctgccatcctcgaacgtcaccggtccgccgatctggaagcccagggtcatcggcatcgagatggtgtcggaggcgtcgtagaccacaccgctaccattgccgaagctgtcgcgggcctcgtccaggtgcagccgggtcggctccaccgccgcgaagggggtgatcttgagcccggcggtcaacggcagggcatagccgacttccagccgcgcgcccagcgtggtgccgtcgaagcgggtcacggccgcgcgggtcagccccaggaagcgcagatcgcgggtgtagcgggtatcgcccgtggcggcatagccgatgaccgaggcataggtatcgccgaagcggcgcagaccatagacgctcaccccatactgcttgccggtgccgctggccgcgagaccgtcgagatcgtagctggtctccccataggtgaaggcaccgccgatcaggaagctgccgtcatcggcgccgccatcgatgccgatggtggtgccgaaataatgcccgtcgaagccgtcgccggtttcgtaggcaccttccggcgtcatccaggcccgtcctccggccatattgccaccctcggacgccgttgccgtctggtcgagggccgcctcccggctgccgggggccgccgctgctgcccccatccgccagctgtccagccggccggtcaccgtctgcatggcgcgggtgctggcggtcagcatgctctgcggcacgctggcggccccggtgtcgccgacgctgcgatagccgcggtcgagcgtcgcggtgtcgctgatcgagaccagaccggcggtgatcgcctttgaatattccgaggccgcctcgctctggatccggccgagcaactcgccgatccgacggccgaagccgctcaacccctcgggggtgaagtcggcatcggcctggatgcccagccggccgtcggtattggtcaggctgtagctcaggatcgcgctggtcggggcggaaagttccagattgccggcggccagcccggtatccgagaccaggacatcggcgatcgccagccggcccggcttcaccgaaccgctgttgatcgtggcgagcgacagcttgccgtccatgctggcagcgccggtgatgtgcagcccgtcggccttgccggtggcatggtcgacgcgcagctgcacttcgccgtcttcggactgggtgaagccgccattgatcgtggtcgtgaccacgcccgtggtcgcctgctgcagccggccgtgattgacgaagctgccggtgccgcccagatcgatgctggcgccggaattgatcgtggccccggcctcgttggtcagcagattggcgccgccgtcgcccagcttgatgctgccggtcagcgtgcccttgttggtgacggtggtgtcgccgatccggctgtcgatcaccagcccgtcgccgcctgcgaaggtctgcagcgtgccggcattggtgacctcgttgatcgggccgtcgagcagcagggcatggccgtcggccgcgccggtgaccaccacgccttcggcgatgtccaccaccgggtcggtggtagaatgcgccaccaccgcgctggcaccggcgccgctgacggtgatcggggcatagacatagaccgagaccgcgtggctgctgccgccgccattgcccgacaggaacagggtggtggtgccgttggtgacgatgccgccgccgccggcggcggactgagcgaccacgccatgggcacccgccccggtggtggtgatgggcgcgttgacgcccaccgtcacactgccggcgctggccttgctcgacgcattggcggccgccgagaccgtgccaccggtggtgagcaccgtgccgccgccggagcccacgctctgcgccagaatgccgaaggagttcacgccggtggtgtagatctggccgttgctggtgatggtgacgttgttgccgtcggcgccgctcgccttgttgccgacccggacggtggcgccggtcgccgccagcgccagaccgccgccgccgccgatcgactgggcgacgagaccgggagaggcggcacccggtggtggtgatggccgcgccattggtcaccgtcagcgtgttcgacttgctggcgaccgtcccgcccagattgaccgaggtggcattgatggccgagaggccgccgccgcccgaaatcacctgggcgaccaggcccggcgcgaagctgccgccggtctggatgctgccgccgctgagggtcatggagaccgcggcattgccgctggtgccgccgccggtgccgcccagatagacgctgcccgagaagaccgcaccgctggtgccggacaccgccatcacgccgccgccgccggtgatcgcctgggcgaccacgccggccgcattgacgccctgggtcagcaccttgggggcgccggtgatggtgatgtcctgggcggaccccgcgccgccctgctggccgagccgggcattgatgctgccgcccgaggcctgggtggcgatcgaggcgaagccgccgccgccacccaccgactgcaccagcacgcccagcgaattggcgcccgaggtctggatgaccgcattgcccagatagcccgccaccgcatcgttctgcgacgggccgccattgcccgagccgcgcacggcgccgagctgcaggttgaccgaggccgaggactgggcggcggtgttggtctgggtgaagaagatgccgttgtcgcccaccgactgcgcgaccacggccgttgcattggccgccgtggtggcgatggtctggttctgggtggtgatcgagacggcgccgccgttcagattgctgccgccgccgcccatattcccgaggccataattggtgacgccggcatcggtgaagaccgaggcgaccacgccgccgccgccgcccaccgactgggccaggatggcggtggagcccacgccgtttgtaatgacactggtcggcacgttcagcgtaacggcgctgccataggcgatggccgagccgaaattggcggaaagctgccggtattccgagaacaccgcaccgccggcgccgccgatcgactgggcgaggatgccataggacacgctgcccacggtctgcaccgtgccgccggtgccggtggtcagccagacattgccggcattggagccgctgacggccgagttgaaatagacctggccggcgccatgggcgagaccgccgccgccgccgattgactgggcgacgatgccgggagaggcgccgctataggtggtgatcagcgccgagcttgtcgccgagaccgtgccgccattgccgttgagcggcccgcccaggcggacggcatcggtatgaatgcccgcgatgccgccgccgcctgcgatcgactgcaccaccaggccgggggcgaaggcgccgctggtggtgacgctgccggccgccagatagccataggcggtgttggcattggcgccgctgccgccggtggcgccgagcgtcaccatccccgagaaccaggaacccgcttgcgaggacaggctggcgatgccgccgccacccgagatcgactgaacgatcacgccggcggcattggtgccgcgggtgaggatgttcgcggtgccgctgacgctggtcggcatggccgatccggcgccgccgcgctggccgatgatgccggcatcgatccagccgccgctcgacagggtggcgatggagacgatgccgccgccgccgccgatcgactggcccaccacgccgtaggcattggcgcccgaggtatcgatggtggtgacgccgccggcgcccagggtgacgttggtggaataggtgatgttctggccgccgtcgcccttgccgaccgaggtgccgagattgatcgcggtgtgcaccgccccctgcgacgcggcattggcctgggtgaaataggtgtggcgcccgaggtatcgatggtggtgacgccgccggcgcccagggtgacgttggtggaataggtgatgttctggccgccgtcgcccttgccgaccgaggtgccgagattgatcgcggtgtgcaccgccccctgcgacgcggcattggcctgggtgaaataggtgccgccggcgcccagcgactgggcgatgacgcccgcgccattggcgccggcggtcgcaatggtctgggtgcgggtggtgacggcgacggtgttgccgttcagcccgctggcgttggcggcgttcagggtaacgccatagctggtgatgttggcgttcgagaaggccgaggcgatcacgccgccgccaccgccgatcgactggccgacgatgccggccgagccggcgcccgaagtgacgacattcgccgccgtatcgatgacgatgctgccgccataggcgatgccggtgccgaagctggcggtcgcctggttgacggggctgaacaccgcgccgccggcaccgccgatcgactgcgccagaatgccgaaggcggtggccccttgagtctggaccgatccgctgccggtggtggtgaccttcacctgcgaggcgttggagccgctgggtgcgttcaggatgacggcattgccgccattggcgagggcgagaccgccgccgccgccgatcgactgggcgacgatgccggccgaggcattgccgatcgtgccgatggcggcagcactgctgacggtaaccgtgttgccgttgccggcaacatagccgcccagatagaccccgctgctgtgaacgcccgaaatgccgccgccaccggcgatcgactgcgccaccagacccggggcgaagacgccgccggtggtgatgctgccaccggtgaggttgacattgaccaccccgccattgccgccgccgccagtataggtgccgagcgtcaccggccccgaatagcccgtgctgcccgactggccggcgaccacggcgatgccgccgccgccgctgatcgactgcgcgaccacgcccagcgcattggtgccacgggtggtgatgttcgccgccccgctgacggtggtggcgaggccgacaccgccgccgccacgggcgccgagccggctgctgtcgatcgacccgccggtcgactgggtggcgatggcatagatgccgccgccggcccccaccgactgcgcgaccacgccgaaagcattggcgcccgaggtatcgatggtggtggcgccgccgctgcccagcgtcaccttcaccgaatcgctctgactgacgccgccattgccgctgccctggccggcacccaggttgaaggtggcatggatgctgccctgggcggcggtgttggtctgggcgtaatacacgccgctggcgccgaccgactgggcgatcaccgctgcgccattggcgcccgaggtcgcaatcgtctggccatgggtggtgaccgcgacattgctgccgtaatcgctgctgccgctgctgccgtagagattggcgacatagctggtataggcggcatcggcgaagctggaggcgatgacgccgccgccgccgcccaccgactgggcgagaatggccgtggagccctggccggtggtcaccacattcgccccggcatcgacatagaccccgcccgcataggcagccgaggcgccgaagctggcgatgacgccgtgattgggggcgatgaaggcaccgccgccgccgccgatcgactgggccaggatgccgaagcccagattgccggtggtctgcagccagccattgccgctggtggtgacccccaccgtgctggcatcgctgccgccggtcgtgctgatgaactgggcattgtagctggtgagcgccaggccaccgccgccgccgatcgactgggcgacgatggcgctggcgccgatgccggacgtcgcaaccggtgccagcgccgtgacgctggcgaccccggcgatgccggccgtgccgccgcccatctgcaccgtatcggtgttcagcgccgagatgccgccgccgcccgcgatcgactgggcgacgatgccatgggcaaacatgccggtggtggtgatgccgccgccgcccgagaggttgacggtggcattgccggcattgttgccgctgccgccccgggcgccgagtactgccgtgccggtgaagaactccagcccgggggtcgcgacggccaggatgccgccgccattgctgaccgactgcgcgacgatgccgaaggcgttgttgccgcgggtgacgatgctggcggcgcccgtcaccgtggtcgccatgcccatgccgttgccgccgcgctggccgagctgcacgcccttggcgttgccataattggcgcgggtggagatggcgacgataccgccgccgccgcccaccgactgtgcgaccgcgccgaaggcgttggcgcccgaggtgtcgatggtggtcacaccacctgcacccagcgtcaccttgatcgcgtcggcgacgttggcgccgccattgccgccggcactgaccgtgcccagatagccggtgacgttgatcgtgccctggctgacggtattggcctgggtgaagtacacgccgccggcgcctaccgactggccgaccacggctgcggcgttcacgcccgaggtcgcgatggtctggttgtgggtggtgacggcgacggtgccggcatagagattgccgttgccggcgctgttcaggcccgtcccgtaattgacgaagccgtcattcgcggtggtggaggcgatcacgccgccgccgccgccgatcgactgacccaggatcgcgaccgagcccgcgcccgaggtgacgacgttcgcgcccgcatcgacggcgatattgccggcatagccgatgccggtgccgagattggtgctgagaggggcagtcggcccgaagatcgcgccgccggcgccgccgatcgactgcgccagaatgccgaaagaggtggtgccctgggtttgaaccgcgccgccgccggaagtggtgacggtcacctggctggcattcgatccgctgggcgtattggcgaaggtgacggcgccggtgccgatggccagcccgccgccgccgccgatcgactgcgcgacgatgcccgcggcggccgtgccgtaggtagtgatcgccgacgagctggcaacgctgacggcgccgccattgccggcgagcacgccgcccagcgtcacgtcattggtgagcacgccggaaatgccgccgccgccggcgatggactgggccaccagaccatgggcataggcaccgccggtggcgatgctgccattggtcaggttgacattcaccgcacgggtatcgctgccattgccgccggtggcacccagccggacattgccggtgaaggccgcccccgactggcccgacaccacgaagatgccgccgccggtgctgatcgactgggcgaccgcgcccagcgcattggtgccgcgggtcacgatattcgcggtgccggtcagcgtagtggcaaggcccgtgccgctgccgccgcgctggcccagaatggcgcccttgaccgtgccgccggtcgcctgggtggcaatcgcgacgatgccgccaccgccgcccaccgactgggcgatcgcgccgaaggcattggcgcccgaggtgtcgatggtggtgagaccaccggcaccgagcgtgaccttgatcgcgtcggcgacgtccgcgccgccattgccgccggcactgacggtgccgagatagccggtgacattgaccgcgccctggctggcgctgttcgcctgggtgaagaacacgccgctggcacccaccgcctggcccaccacggctgcggcgttcacgcccgaggtcgcgatggtctggttgtgggtggtgacggcgacggtgccggcgttcagattgccgttaccggcgctgttcagccccgtcccgtaattgacgaagccggcattcgcggtagtggaggcgatcacgccgccgccgccgccgatcgactgccccaggatcgtgaccgaacccgcgcccgaggtgacgacgttcgcccccgcatcgatgccgatattgccggcatagccgatgcccgtgccgagattggtgctgaggagagacgtcggcccgaagatcgcgccgccgccgccgcccaccgactgcgccagaatgccgaaagaggtggtgccctgggtttgaaccgcgccgccgccggaagtggtgacggtcacctggctggcattcgacccgctgggggtattggcgaaggtgacggcgccggtgccgatggcaagcccgccgccgccgccgatcgactgggcgacgatgccggccgccgccgtgccgtaggtggtgatcgccgacgagctggcaacgctgacggtgccgccattgccggcgaccacgccgcccagcgtcacgtcgttggtcagcacgccggaaatgccgccgccgccggcgatggactgggccaccagaccatgggcataggcaccgccggtggcgatgctgccattggtcaggttaacggtcaccgttcggccgttgctgccgctgccgccgatggcgcccagccggacattaccggtgaaggccgcccccgtctggcccgagaccacgacgatgccgccgccattgctgaccgactgggcaaccgcacccagcgcattggtgccgcgggtcacgatgttggcggtccccgtcagcgtggtggccatgccgctgccgctgccgccgcgctggcccagaatggcggtgccgacggtgccgccggtcgcctggttggagatcgcgatgatgccgccgccgccacccaccgcctgggcgaccgcgccgaaggcattggcgcccgaggtatcgatggtggtgacaccgcctgtgccgagcgcgatcctgatcgcatcggcctggtccacgccgccattgccgctgccgtaggcggtgcccagataggccgtgacgctgaccgcgccctggctggcggtattggcctggctgaagaaggtcccgcccgcgccgatcgactggccgaccacggcggcggcattggcgccggcggtggcgatggtctgattgcgggtggtgatggacatggtgccggcattcagtccgctggcattggcgccgttcagcccgaccgcataagaggtgaaaccggcatccgatgcggtggaggcgaccacgccgccgccgccggcgatcgactggccgagcacggcgacagaggccatacccgtcgtgatgacattcgcgcccgcatcgatcccgacattgtcggcataggcgatcgaggcgccgaaattggcgccgagcagccggttaggcccgaagaccgcaccgccaccgccgccgatcgactgcgccaggatgccgaaagaagtggccccttgagtctgcaccgcgccggccccggtggtggtgacaaggacctggcgcgaattcgatgcgctgggcgcgctggcgaagttgacctggccgtcgctggtcgcgatgccgccgccgccaccgatcgactgggcgatgatgcccgaggcggaggtaccataggtggtgatggccgacgagctggcgaccgtgaccgtgttgccatagccggccaccacgccgccgagcgtgaggctggtggtgcggatgccggaaatcccgccgccgcccgcgatcgactggacgaccagaccatgggcgttgaagccgttggtgacgatccgcccgccggtgaggttgacgttcaccgtgccgccgtcacccgtgccgccaccggtggcgccgagccgcgtgctgcccgagaagatggcgccggagccggcggcggcgagggcgacaccgccaccgccggtcaccgactgcaccaccgcgccgatcgcattgtcggcatgggtgatgatgctggccgttcccgacagcgtaaccgcgcggccgttgccgccgccgcccgactggccgagctgggccgtggccgtggtgctgccggccgaggtggtcgcgaagccggcgatgccgccgccgctgccgatcgactggacggcgacgcccatcgaattgcggccccaggtttcgatcgaggtggtgccgccgttatcgcccagggtcagcatcaccgcatcggccgcactggtgccgccgctgccgccgccccggctggcgccgagggtgaaggtgggcgaaaccgcgcccgaaatcttgccggcgctgaaggttgcgataccgccgccgccgccgatcgactgcaccaccagggcgctggcattgtcgccgccggtctggatcagcgccgaggtgccgccgcccgtgctgaccaggatcttgccgccgtcgccggcattgctcgacgacgaaccgagggtgaggctggccgaggccgaggcgcgggtggcgctggtaatgtcgatgatgtcggaaatgccgccgccgccgccgatcgattgggcgatgaccgcactgctgccgatgcccgaggcggtgatgtcgcgggtgatgtaaacgctgacggttccgcccgagcccgaaatgccgccgccgccgccgagggtgaccggcgccgaaatcttgccccccgaggcgctggactgggccgagccgccgaggccgccgccgccgccaacagactgggcgacgatcgcatgcgcggcgccggctgcggtggtgatcacgccgcggctggtgaccgtgacgccctggccgttctggccgccgccgcccgatccgccgagggccatggcgagcgaggcttcaccaccctgggccgaggtcgacgacgcgccgccggcatcgccgccgccaccacccaccgactgggcaaagatgccgtgcgagaggaagccgtaggtggcgagcgtgccgtcattcacgacatagacggcgccgccggccccgccattgccgcccgatccgccgagcgcaaagctggtggcataggcgccgctattggcattggtggtggccgaggcgccggtgccgccgccgccgcccaccgactgggcgtagatcgcggtcgcatgggcgcccgcggtccggatggtcgtggcgctgttcaccgaaaccgtgccgccggacccgccgccgccgcccgatccgccgaggccggcggacatcgccacacccttggaggtggaggcagaggtaccggtggagccgctggagacgctggcgccgggttcgctgtcatccgcctggccggcggtggccgaggtggtgaccgcgccgccattgccgccgccaccacccaccgactggacatagatgccgtaggagagatcgccccaggtggtgatggaggtggggcgtgcctgatcgttgttgcagatgttgttcgaaatgctgccgcagacattcacgctgccgccggcgccgcccccggcgcccgatccgccgaggccgagcgccaccgaggccgagccgcccgagccggtggtggagctggacgagccgccattgccgccgccgccacccaccgactgggcatagaccgccgccgcattggcgccataggtggtgagcgtgccgccgccgaggccgacattcacggcaccgcccgcgccggcgccgccgccggtaccccccatcgagagcgcgacgctggccttgccggcatcggcattggaactggccgagccgccattgccgccaccgccgcccaccgactgagcgaagatcgcctgggagttgaggccgcccttgccgtcggaggtgccggtggtgatgctggccgagttggtgaccacgatgctgccgccggccgcaccgccgccgcccgagccgccgatcgcgaggccggcggcatagccgccatcggcgcccgcctggctgccctgagaggtggagccggtcttgccggcagaggccgaattgtggctgctgttcgactggccggaacccgaggtcggcacggtgccggtggaggcgctggtggacccgtcttcttcgtcttcatccgaggccggcgccgcggtcgccgccgtggtcgccccgccgccattgccgccgccgccgcccaccgactgggcgaaaatgccggccgaattgatgcccgtggtcctgagcgtgccgaaattcagcacggtgaccagattggcagccccgccaccgccgcccgagccgccgagcccgaaagagagggcgcccgagccgccgctttcgacggtgctggaggcggcaccgccattgccgccgccgccacccaccgactgggcgaagatcgccgccgattgcaggccgctggtggtgatgctgccggtgttcacgaccgtcgcggtcgatccggcgccgccgccaccaccggtgccgcccaggctgatggaacccgcataattgccgccggccgcattggtggtggcagagccgccattgccgccgccgccgcccaccgactgggcggtgatgccgttcgacagcatgcccgaggtggtgatggtggcaacgctgctgaccagcacggcgccgccattgccggccttgccgccggcgccgccgatggcgagcgaggcgccgacgccgttatcggcttcctcgtcggtcgaggcagccgggccgctctgcgagaactgggcggcggtcgcgaccgccgcaccggtattggtctgctgggcgaagccggtgccggtataggccgcgacaccgccatccagcgcgccgccctgctggccggtggccgaagcggtggccgtgccgccatcgccgccgccacctccgaccgactgggcgaagatcgccgtcgacccggcaccggtggtggcgagcgtgccgccggcgaccaccgtcaccgcatcggcattgccgccgccgccgccaaagccgcccaccgccagagatgcggcatatttgttgctggaggcgctgctttccgaatagccgccgcggccgccgccgccgcccaccgactgggcatagatggcgcttgcgtggttgccataggtcaggatgctgccgccggtggcggtgacgccaccccagggattgctgcagctgcccgagctgacattgccgcagacggtgaccctgccgccggtcccgccggtgccgccgccgccgccgactgcgaccgaaatggcgcccgtgcccgaaatcgcattggcataggccgagccgccattgccgccgctgccgcccaccgactgcgccaggatggcgaccgagcggtcgccggcgcccggattgcccggcacgacgccggccatgccggtctggatgctgccggtcagcgtgacggcgaccgcgccggcattgccgccggccgcacccgacccgccgatcgcgaccgatgccgaaccgctctgggagttctcgccgccgcccgaggccgaggccgcgaaggccgaggcattgccgccattgccgccgccgccgccgatcgactgggcgatgatgccgtaggcgtcgaagccggtggtgaccaggttgttggcgaccgtcaccgaaaccgcgccgccgttctggcccgacccgccgctgccgccggtggcgccggccgcaccgaccgaaatcttggaggccgggttgccggtcgagatcgagccggaataggcggcgccaccgctgccgccggtgccgccgatcgactgggcgatgatcgccgcggcaagatcgcctgcggtcgagatgccggtataggtgttgaccgtaaccgtaccgccggtgccgccgctgccgccatagccgccgaccgcgaccgccggggccgcgatggtcgatcctgctgcgccggcgctgaagccgccgaggccgccgctgccgccgatcgactgtgccacgatgccgtgcgacagaaggccggtggtggtgatggtgtcgtaggtggcaatggtcacgccgcccgcggcgccgccgccgccgccactgccgcccaggctgaccccggccgaacccagcccgcccaggctgccggcgatgtcccagccgccattgccgccggcaccgccgatcgactgggccagaacgccggccgactgatggccggtggtcgagacgcgcccgccgccctggatggtgaccgtcacctggctggcgcggccacccttgccgccgccgccgccgatcgcggccgagactgcgccgctttcgccgaaggagccggcgatggcgaaaccgcccgagccgccattgccgcccatcgactgggcgaccacgccgggcgagagcggtccggtgacggtgagggccgaataattgtcgacggtgaccgtgccgccggtgccgccattgccgccgccgccgcccaccgccatactggcggtgccgttcgagctgagaccggcggcacccgagaagccgcccgagccgccaccgccgccgatcgactgcgccagaagggcaggggcattgccggtgctggcggccgacacgttgaccgccgcctgattgaccagcgtgaccgcgccaccggcgccacccgcggcaccgctgccgccggcgccgatattggccgaaaccgatccgctgatcgagcctgcgaccgcatagccgcccgagccgccgccgccgccgatcgactgggcggcgatcgccgccgcaccgccgccataggtattgatcagcccggtgttcaccacctggaccgtaccgccattattgccgctgccgccggcaccgccgatcgcggccgaggcgccgctggaatagctgagcgcgcccgaggtggtgtagccgccattgccgccgccaccgccgatcgactgcgccagaatggcgctggcgccatagccataggtggtgatcgcggcggtctggctgctgttggcggcataattgtgggcggtgaccgcgcccgcggcaccaccggcgccgcccgacccgccgacacccagcgacaccgccagctgcgggctggccgaaagccccagcgccgagccgccggagccgccgccgccgccgatggactgggccagaatgccgtgcgagctgtcgcccgaggtggtgatgacgctgccggtgttctcgacgatcaccgtgctgccggcacccgcggcgccgccggatccgccgacgccgaagctgagggcgctgttcgcgaccgccaggctggcatcgaccgtcgagccgccgccaccgccaccgccgccgatcgactggccgaccagggccgaggcgccgacaccggtggtggtcagcgtgatgccgttcgggctgacatagacctggccgccattgccacccttgccgcccttgccgccgtaagacagcgcgaaactgccctggaagccggccgccagagagaccgcatagccgcccgagccgccgccaccgccgatcgactggccggcgattgccgaggagccgtcgccgacggtcgagatggtcttgcccgtggtcagcccggaaagccggccctggccgctgcaggcgccggcggcggaggaatcgccgctgaagctgttgcagttgatcgcgaccgacccggccgagccgccatcaccacccgatccgccatgggagagcgaggcgctctgcccggaactggccgagagcgccacagcgccgccgccgacaccaccaccgccgccgaccgactgggcgaggatgccggccgaattcacctccaccgtcgtgatcgagccggtgctgagcacggcgaccgagccggcgctgccgccgccgccgccggacccgccgaccgcgaaggccaggcccgagccggagcccgagacgccccatcgccgccgaccccgccaccgccgcccaccgactgtgccagcacgccgacggcaccgccggccgagtcggtggtgacgggggtgggggcgagcgaggggatgcagccattgccggtgcagatgtcggctgtattgttcaccgccaccgatccgcccgaaccgccatcgccgcctgaaccgccgacggcgaccgacgcagtgctgcctgaagccgagaaggccatgccgccgctgccgccggcaccgcccaccgactgagcgaagatgccgaccgaggacgggccataggcggtgatggtgctggaattgttgaccgtgaccaggctgcccgatccggccctgccgccatcggcacccagcgccaccaggcctgccgcgacaccggcattgccgccgccgccgccgaccgattgggcatagatcgccgtcgcaccggcggcggccgaggggttcgcggcgctgccgaccgtcagcacgccgatattgttgatcgtcaccagcccggcattgccgccatagccgccaccgccgctatagccgccgaaggtgccgttgctgctgccgccatcgccgccgaagccgccgatcgactgggcggcaaggggggtgccggccgcggtggtgatcgcggcattgttagtgatggtgacattgccgccggcaccgccgggcacgccgtcgccgccatcgccccagagaccgccattattgttgccgccatcgccgccctggccgccggcgctctgcgccacgatgccgagcgacgacgagccgccctggatgttgagcgccatgttgttggtgacggtgacggcgccgccggcaccgcccgacccgccatcgccgccatgggcgccgggatcgttggtgttgccgccggtcccgccggtgccgccctggctgtaggcgacgacggtggtgttcgcgatcggataggtggcggaactggtgccgttgagcgtgacggtcacggcaccgccggtgccgccggtgccgccgccgcggccattgccacagacgccggtcttgtcggaaccacccgtgccgccggtgccgccggtgctaccggcgatcaccagcgtgccgccataggcggtggtcgtggagatgtcgggcgtgacggtcgcggttacggcggtaccggtcgggccctggccgccactgtcgggcttgtcgcagctgaagccgttgaagctggcgttcgatcccttggatccggtgccgggtgagggctgctggttgacataataataggccggcccggtcgagacctcggcgttctcggcacgtgccggcccggccgtgatcagtgcgccgcagacgccaagacccagtacggcgccgatggccgtcatgttcccgcgataaaggaaggaacccgacttcgccatcggtcttgcctctcatgccgtcggtccggggcctgcgccgccgccgttcaggtctgtcgtccacaatcgcccggccgcgcggggcgggtttctgaactcacttcaccgcgtcgaaggcagcggtgaaatccatcagcatatgggggaaggtcagcacggcgccgttgccggcgacggcgcggaccgacatcaccttgccggcgcgcatcgccttcagaagatcgttgttgagcggcagggccgcgaagcagccgcgaccgtcgcaggaccgcacggtcaccggcaccggcgtgccgtcatccaccgccagggtcaccggctcggtcagggtcaggccggtcggcagttgcagcaccagctcgggcttgcggctttcgcccggcacgctgaccaccgccaccgacatcagctggccgttatcgctgttgaacagccgctgctccatggtgcagtcggctgcggcggcgcgcccgcgcgagacgcaggtcaccgtccaggccggggccgagccgtccaccttctgcggttcggccggggcgggggcatcggccggctttgtggcgggcgcgctctgcgccaccgcgccggcggtgcccgccaggccaagggtcgccgcaagcgtggcggcaaggagaaccagacgggcggtggagccgcgctgcatcatcgtaaggacgtcccgggaaggatatgtcggacagggggcaatacgggcccgtcgaggcccgtgccccatcatccttcaccaaagctttgcacggcgcaacagtaaagcccgatcgtcacacaacagctgttaagctgtgcgccagatgatgctttacgccccggatttcctgatttttaaccatatgaagtgaaggtcacataccgcgtttcatgtcgcgaattctgcgctgcaaatggcggtttacatgctccgcgtcgccgcttgacggccgccgccgatcagtggccgcgcggcacgaccagaacgtcgggctccaccctcgccaggatgcgtttggccatgctgcccagcacggcctcggccaccacgccctggccgcgggtgcccagcaccaccagatcggcatggtcgcgggccagttcagtcgccaccgcatcgtctgccggcccgggcagcacgatgcgtgtcagcccgtcgagccgggcggtcggcaccgccagcgcgtcgatctcatccgtcagccggcgtgctgcggtatcgccatgcgcgcggatctggacggccggatcggtcgagattttctgaaacggggtctcgaaggcgtggatcaccgtggccggcacctcgggcagcagggtcagcgcagcctcggctgcccggcgggcaggggctgaaagatcggtggcgatcagcatccggcgataggggccggtcgcccgccgccgtaccaccagcaccggcacggccgatcggcgcagcagccggtccaccgtatcgcccaacagcagccggcccaggggctcgctgcgggcaaggccggtgacgatcagatcgaagccttcatcttcggcgatccggcggatcgtcgccgccgggtcgccatccgccacccgggtgcggatggtgacggggccggacggggcgccgatgtccgccagcacggccgccggcagatcggccagcagccgggcttcggcctgccgcagccggtcttccgtgccgatctcttcggcagcatcgggctcgctcacatgcagcaccgtcagcgccgccccggtctcgcgggccaacgccaccgcccggtcgagcgcccgatcgctgcgggcactgagatcggtggccagcagaatgcgggcaagcgggtggggggcggcaggggtcggcatgatgtcctccttggtcgcagcgtcggctgaaccttaccccgctccgtcgctgcccgccatctcggtgcccagatgcaccgccagccacaccgtcggctggtgatcgtcggtccaactgacccggtggcgcagccgggcgggcagcatcacatggtcgcccgggccgagcacggtttcgccctggccctcgatcagcagcccggccgatccggtcagcagcagcacccattcatcccacccctgatcgtaccactccccctcgggcgtggcctggccccacgacacgatccgctcgatgcggatgccggggcgggtcaggatctcggtgaaggcctcgtcgatcgagcggggtggcaggggtgagagcaggttgggcatcggggtccggatgatggcgggtgcgaagggggcgatttcgcgggggcatgctccactccaggccgtggcgcggacgctgtcaacggctttcgcatctgcagtatcgcccggcaagggcggcccgggaacagccggtccggcgcatcgttgtcgtccaacggggcgcgggtcggccgcgcccctcgttcaacgcgaaacgaggtcgag

SEQ ID NO: 65 - DNA, 1126962 bp, Tistrella mobilis
gtgatcaccatggtcatgttggccaagatccggcggatgcatttccgcgatggcctgccgctgcgcgagatcgccaagcgcacgggcctatcccgcaataccatccggcgatggctgcgcagcggccagtccgagccggtctatcccaggcgagcctcgccctcccggctcgatccctaccggtcccagttggagacgtggctgcgtgccgacagccatcgtccccggcgggaacaacgcaccgccaaggtgctgttctcgcagttgcaggcgatcggctatccgggcacctacacccgggtgacggccttcatccgccagtggaaggcggccggcggcgccagccgccgcccggccttcgtgccgttgcactttcctccgggtgaagccttccagttcgactggagccgcgagtacgccttcgtcggcagccacgccaagatgccgctggatctcgcccacgtgaagctggcctgcagccgcgccttctggttggtggcctatcccacccagagccacgagatgctgttcgatgctcatacccaggcgtttaccgccttcggtggcgtgccgcgccgcggcatctacgacaacatgaagacggcggtggacgggatcggccagcaccgggaacggcgggtcaacgcccgcttccacgccatgaccagccactacctgttcgccgcggagttctgcaaccgcgccgcgggttgggagaaggggcgggtcgagaagaacgtgcaggaccggcgccgacagatctggatcgaggccggggcccgccactggccagatctggacaccctcaatgcctggctcgccagcgagtgccgcgccgcttggccgatgcaggcgcatccggatgcctccgacatcaccgtggccgaagctctggaggacgaacagccccacctgatgccgatgcccgcgcccttcgacggctacatcgagcggccggtgcgggtcagttcgaccgcgctggtcagcttccagcgcaaccgctacagcgtgccgtgcgaacacgcccacgccgtcgccagcctgcgcgtgtatcccttcgaactggccgtggtggtcggcgaggccgaggtcgcccgccaccggcgcagcttcgagcgtgatcgggtccactacgactggcagcactacatcgccctggtccagcgcaagccgggggcactgcgtgacggcgcgccgttcctgtccatgcccgatccgctgcgcaagctgcagcaggtgttgctgcgccagcctcacggcgaccgcgccatggcccaggtgctggccgccgtacccgtgcacgggctcgaagcggtactggtggcggtggaactggcactcgagtccggcctggtgcgcgccgaccacgtgctcaacgtgctggggcgattgcagcatccggaccgcacgatcgagacggtcgcctcgcgagtgacgctgcgtcatccgccggtgtccgatccggcccgctacgacgccctgcgggaggcagatcatgtcgacgcctgacctgccgctgcgcatgcagcagctcaagctgcacggcatggccagccagtggcccgaactgctggccaagatgcgcctgcacaccatggagcccgaacactggatggccgaactgctgcaggccgagtccgccgaacggcaggttcgtgcccaggccaaccagatgaaggccgcacgtttccccgtccatcgtgacctgctcgggttcgacttcgcggccagtcccgttgatcgcgcactggtcgaacgactccaccagggtgacttcatccacacccccgagaacgtcgtccttgtcggtggaccgggcaccggcaagacccacctggccaccgccatcggcatccaggccgtgcgccagcatcgcctgcgcgtgcgcttcttctccaccatcgaactggtcaatgcgctggagaaggaacaggcccagggcaaggccgggcagatcgccctgcgcctgacctatgccgacctggtcatcctcgatgaactgggctacctgccgttcaccccctcaggcggcgcgctgctgttccacctgatcagcaagctctacgagcgcaccagcctcgccatcaccaccaacttggccttctccgaatggggtcaggtgttcggcgacgccaagatgaccaccgcgctgctggatcgcatcacccaccactgccacatcctggagaccggcaacgactcctggcggctgcgcaacagcaccgccgccaacaagaccaaagccagaatcagggcaaaggaggccaccacccagaccaccaactgataccctcagccccgtacaccgggtgggtcaaagttcaacgcgcagcctgggtcagttttaagtgcgcgccaacagacgttggcagcgggggagccgctgaggtggccggcgcgccattgggcgacgccccatccaacggcaataccggcagcaaccagcgtcaagccggcaaggatgtttctcgaagaggtattcatggcgagggtctccactcagtccgcgatcaggctgttcagtcgggcgacgaggctgtcgcgctgcgctccaaggtcgatcagacgcatgcgcgtctccagcacctgggcgcgtgcactgagcacagcgctcaggtcccccttggcggatcggtagttgctcaatgcaagcgccgctcggttccgtaccagttgcaagccggcggtctgcaggcggtcgatctggctgttcaacgcttggagttcggcggcgctgtcgtccagctcctgcaaatgccgccgcgccacgtcttcgcgttcggcgtccagacgttccaactcgtgccgttttgcctcgatcatgggcacttggcgtcgatccttctgccaaggcagatcgaatgtcacctgaaatgacaccatgtcgccccatcggcgatcacgccggctataggctatctcccaggcccaatcgccgcgggtctctgattgggcttcgcgggactcggcccgggccatgctttgcatcgccggatagagttcaagctccgcgtgattcgccagttctgtgcgcagttgcgcgacggggcgagtgagcgggcctggatcgccttgcagtgcttcgtcggccctggagcccacccagcgccgcaacgcggccctggccttggcccggtcccgctgtagatcgtcacggcggtccgtgagtgtcagcgcctcctgttccgcgaccaacagatcgccagcctgggcggtgccgccggcgacgcgagcggggagactgtcttgcaggcgctggttctccgcgagcagttccgtcagcagtatctcccgttgctccaccgcctgcgcggcgatccacgccaggctgagttcctggcggatctgcaatcgctgcaaaaccagcgccgcgcgttctcgatccacacgcgcctgcgcgctggcgacctgggcgtcgcgcttggccctgttgggcacttcctgcatgagcgccaagcgctgcatcgtcatggattcgcgcgtcatgctccagcgatccatgccgctgatggggtagttttcgatgccgagcgagagcttggggtcgggcagcgagcctgctgccttctgcacggattcggcgacgttaacctgcaactgctgcgcgcttatgcgtgggctctgctgctccgcgataaggcgtgcctcagcaaaatcgagggcgtaggctacaggcgagacaagcgcactgcccgccaacgcgatgctgatagctttcagacgatgcactcgcatcgaggccggcgttgtgcctcggccgtacgccgacgggcgcccctcgggggcgccaaaaaagggagtaaacatggttgtcctcggaattggtattcacgaaatcacgtggtctgccgcatcggtgcgcggcgagcacggacacataaatcaattccgcaggacttggaacgtgaggtagatcggcggaaagcccgcgcggggattgggaggaatgtaggtaacgtgccgcctgagaacgtgttcaaagtctcgccctcttgatgtgagaagctcgctgggtgagaaaaggctaccccagcgacatcaagcgcgagcagttcgaggtgatccggccattgctggagagtgcgcgcagaaagactgccccacgcaaagtggagctgtacgaggtgttctgcgccgtgctgtacctgctgcgcacgggctgtcagtggcgggcactgcccagcgactttcccaaatggcgcaccgtgcactcgtactttgccatctggagcgagccacgcgagggtggcagcctgctggagcaggcattaaaaaaatcaggttggcgcggcccgcgagaaactggggcgcaacgcctgcagcacgctcttgatcgtggacgcgcagagcgtgaagaacacggacacggcgggcttgaagggctatgacgcaggcaagaaggtctcgggcatcaagcgccacatcgcggtggacacccagggattgccgcatgcgatagcggtgaccacggccgaggtgacggaccgcaaaggcgcactgcaggcgctacagcgctgcaagccccggttgagccggctacaaagcctgctgtgcgatgcaggctacatcggtcggccgttcgcgcaaggcgtgcagcagattctgggagggcatgtgacggtgcagatcgccaagagaagcgagcttcacactttcaaagtgatgcccaagcgctgggtcgtggaacgcagctttgcctggctggacaagaacaggaggctgtggaagaactgcgagcgatggctcaacaccagcctgcagttcgtccacttggcattcttggtgctcttgctcaaaagactttgaacacgctctgagggctacccggtcgagaaccaacccgggcagcgagttggcgagccacatcacgtgcgccgcgagaaactgaatgtccagcccctgccatgaaagcgccgactcccgatcgccactgcaatgagcgtggcacaactgtggcgcttcgctgtccatggaatcaggcatgccggtgcaatccgacattggcaacttgtcagcctgctgcatcgagatcgtggcacgcatttgcgtggtttccacagatgccctcgggtctggcttgggacagacgtacatcgccatcgcaacctgcgagaaaagcaaggttacgactaggccgctggtaatccagcggctccatcttgcgagaaggcgccttaagccgatcatgcggacatactattggaagttgtagggagttgaattgatcaaggtcagtttccaggatgaattgatgcgtctggacggcgccttggcccgaaccggcacccgctgcaaatccaccggcaagggcgggcaccgcacgtggttgtcatgctttacgcgcctcggcaactcgcaaggctctaagctcaaatcgatcagctacaagattcgtctgtcccgagagtcgctgcaggtgcgtaatgacctcgtaggggccatcggctattgggcgcgtgcagattccgcactggctagcggtttcgatgcgtgatcgcgaggaaatccctacgccatatccagctgcgacccagagcaataacatctcaaaagaactgacatgctggacattcggcctttccgttgatgacatggaggacaggtactggtccagcgaaggagaatattcggccttccatcgaaacacggagtgctccttaagttcgtctattctgattgactgctgccggagcagtgggtatcgcagcggcgtggcaagagctgtcgcctcgaaccaaatagaaagactcttcagcgaagaatcgctcacctgcttcagagaaaggccgacgtcgaagcgccgtttgtagaggcccgtaatgagatcgctcgccgtaacctcattaaattccatagaaacttcgggctcctccgcgcgctgcagggcaagcaatgcagctaggtacgaagaggccacaccaggcgctatggcgagcctgagctgtgggcgtgggctggtggcgtcgtgcatgagaggccccaagaagcgataagacaaggatggaaagtcttcatgatagctagtttgagttaaacttaacgtggttaaattgtttggactgttcgacgcttccaaggatggagaagcgaactgtccgacgaggccgtcccccaggaactaccactttcgacgccgagccagcgttggcattcggagcggccgttcgtgtcgcccgcctgacgcaaggtgttgctcaggaagaactggctgcgaaagcagggatcgagcgatcgcacatgggcaaaatagagcgtggggagcacatgcccactctcgctctgatcttaagaatcgccgccggactcaagctcagtgctgcggaactcgtcagcgcagccgaacgcaatcttcgtgccgcggcgcacgattcagataggcattgacgctttagtcatccggaggtcctcgcagacgttcgatgaagcgatccagcgaaaccgatgagttgctgctttctggccgaagcagataggttgtgattaccgccgtgtcctgcgccagagggcgaatcaccacgtccggcctctggctgatgggaatcttggtcgccgtcatgaaaccaatcccatagcctgcgccgacgagcgttagcatcatgtccagcgacgacacttcttcgacaacgttgagtctgtgttccagaacctgtagcagccgatttagttctcggcagtagccttcgcaggccagtttgtcgcacagaaccagtgggtgaccctgaagttcgttcagcggaacttgcttgtgcgcaagaagcgagtgccgcgctggcacggcgatcacaatcgggtctcgccagatcggttcagccacgatgccttcgccaacatccgccgcgtgtgcaaatccgatcgtgaagtcgccagaccgtaggccccgtatctgctcggtcagcggtacctcggagagacgtatctcgacctcgggctcttccgcgcggcaacgagctaggaacgccgatagtcgtgggtccatcgcaccatcggaaattgcaatgcgcaggctgcccctcaggcccgcggcaatggctctggcattttcacgcgcttgctccaggacagtgaagagtcggcgggtgtcctgcaagaatgccgcccccgccacggtcagccgtgtgcccctgcggtcgcggtcaaacagcgtgaccccaagctcatcttccaattccttgatcgcgcgagacaaggggggttgctctatatgcagcctctcggccgcccgcgtgaaatgcaactcctctgccaagacgacaaagcatcgtagatgacgcaactccataaatcgggctcctcgcaagttctcattcgcgccagatgtcccgtggacgaatcacggtggacggggaggctggatccatttcagggaagttgatgcgcttgacatcgcaaaaactggcaccttgagcgctcgtggttgctcgtgacgcgtcccaagcgcgcgcgcccaatcggggcgcgcgtctctgtcacactgtgcagaagctttgaaaagcaccgcacacccgcggcgtcatccgccgtgctctttttgtagcagcgacccgaggcgagcgacttcattgctggtgatcgcgatgttgcgcccatccttcgtcgacaccgaagctccgacattgagatagacggcgcgcccgaagcggctttcctgtgccatctttccgtccttgaagatgtacagcgttccaccgtcagccaagggaaccatctccttggctgcttgggctgctgcatgaccggcgaaggctggcacggagagagcgctcaacagggcggcaatgacaatttgcgatttcatgatcgactcctttgtaaaaacgacgacaacttgcgccgcgtcgttaaatgtagaagcaggccgtctacagagcgcttacccgtgcattacattcaattcatgtgctgtcatctgccgcccatgaaggactagggtccagtgggagacaagatgccaagccatgcaacgctcgccagaaccaaaacggccaaggtcgcctccgtgaacagactctgcctaagcttgatgactgcctgtgcgcgattgcctgccttcaaagcagcctccaggctcgggctcaaccgataccgattggcagcagccaacgccagcatgcctgcgaaaagcaagagctttaccatcagcagccggccatacagcgtcgagatgagcggatcaaacgatggtccgacgatcaacaggtaattgagaattccactcacgacgagtgcagccacgatcgctgtacctatgcgagcaaagccattcgacgtccgactgaggaccgctaccgggtcttgcgcgacatcctgcttgtgggatgccagcatcaagaacgccaccaatgcgcccacccaagcgcccgctgcccagaggtgcgtgatatccgacgcaagatggatgtagccgcgaacgccgtcgtccatcgcgccgtggcctgcccacgcaagggtcgccagcgccacgccggtggagagcgccatcactgcaaatcgcaaggtagcgttcaatttcaacattgcgacgagcacacacaccaacagcgcgaggatgcgaatgcaccaggcgatgcccatgtgcgtgcccgtaatgagcatgtcgaagacgtgcgttgacagctccgcgtagctctgggcaccggacatggccttggccatgaccgtcatgccccacatcgacagggcaatgccgatggcagcggatgcgccaatgaggacgcgatagcggcgcgagatcgtcgcggatcgctcgtcgttgcccaaagcatagagaccgaacatggcgacgccaaacgccgccgccaggtccagatacagcgccaggcgcaggacgatggtcaaccaatccccggccatgggcttacttcaccttgaaggtgacgttacccgtgatcggatgcgtgtccgaggagacggcacgccattcgacgcgatagtcaccgggctggagcgcctgtgccggcgtgatgaccatggtcttgccgtcgccggcacccgcgacgctggcgttgatcttcatcgggccatggctcgccattcccggcatgcccgtcatgacaaggcttgcggcggagaactgcggcaccagcgtttcggagaacttcagctcgatggtggctggcgcggaaacctgcgacttgtcggccggcgttgaagacaccagcgaaggatgcgcgaatgcggcggtggcgaacaggccagcagcgatcggcgcgacgagcttggcgatgaaatgtgaacgggtcatagagattcctaccttgatgtgtgagggtggtttaagaacgaaatgccgagataaggcttgcaccttcgcaacggcgtggaacgaaagaaacggttcgctgggcgatagcagactcctgttggttctgaaagatgtttcggtcacagtcggctcgctctcagccgcaaggcgttgcccacgaccgatgccgaactcaggctcatcgccaatgctgcgatcaggggcgacagcaaccagcccgtgaggggatagagaaccccggcggcgatggggatgcccagcgcgttgtagaggaaggcgaacatgaggttctgcttcatgttgcccacggtactcaccgagagcgtgcgagcgacagcaatgccacgcaggtcgcccttgaccagcgtgacctgagcgctgttcatcgccacgtcggttcccgttcccatggcgatgcccacgtctgccttcgccaaggccggcgcgtcgttgatgccgtctccggccatggcgacgatgcggccttctttctgcagccgctcgatcaacatgagcttgtccgccggcttgacctcaccatgcacctcgtcgatgcctaggcgtgcaccgacggctttggcggtggtctgcccgtccccggtggccatgatgacccgcaggcccgcagccttcaacgcggccagggcctcgggggtgctgcccttgaccgggtcggatacggcgagcaaacccgcgagttgcccgtccacagccaagtacatgacgctggccccttcgccgcgcagagtttcggcctggggtacgagcggttccaccgatacgccagactgttccatcagcactgtgttgcccaacgccagttgccggtgctcaacctttccgcgcacgccgatgccggttcccgattcaaagctctgaggcttcacgagttggaggccctgggcacgcgcggcctgcacgatggcgtcggccagggggtgttcactgccctggtccaggctggccgcaagacgcagcacctcatcgttcgtaaagccgcgtgctgcgacgacctgatcgaaagcaggtcggccttcggtcagggttcctgtcttgtcgatgacgagggtatcgaccttgcgaagattctcgatcgccgcggcatcgcggaacaacacgccctgcgtggcgccacggcccgttgcgaccatgatcgacatcggcgtggccagacccagcgcgcacgggcaggcgatgatcaggacggccaccgcattgatcagtccatagacccaggtgggctgtggcccgaagaatccccatacaaagagcgtcgtgaccgcaatggcgacgacggccatcacgaagtagccggcaacgacatcggccatgcgttgcatcggtgccttggaacgctgcgcctgggcgaccatctggacgatctgcgatagaacggtgtccgagccgatccgctccgaacgcatgaccagcgcgccgttggtgttgagtgtggccccgatgaccttgtcgcccgcgcgcttgctgacgggcagcggttcgccggtcagcatggattcgtcaatcgagctgctgccctcgtgcacgatgccatccaccggcaccttctcgccgggtcggatgcgcagcaggtcgccgacgtgcacatggctgagcggcacgtcttcctcgctgccgtccgcattgatgcgccgcgccgtcttgggtgccagccccagcagcgacttgatggctgccgaagtctgggagcgggccttgagttccagcacctggccgagcagtgtcagcgagatgatgacggcggcggcctcgaaatacacgccgacccgtcccatggacatgaaggaagctggaaacacttccggcgcaacggttgccacaacgctgtagatgaatgccgcacccgttcccaggccgatcagtgtccacatgttcgggctgcggttgaccacggacagccagccgcgggagaagaagggccagccggcccacagcacgatcggcaacgacagcaccaactcgacccagctctgcgtagccatgtccatcaggtgcagccgctcgcccagcatcgccagcgccaggaccacgagcgtcaacggcaaggtccaccagaagcgacgcgagaagtcacgcaactccgggttgtcgtcgtcgaggtcgggcagcaggggctccagcgtcatcccgcacttggggcaggttcccggatgatcctggcggatctccgggtgcatcgggcaggtgtagatcgttccgggtgcggttggcgatgccgccggggccggtgaaactgcggtgctggcatggtgatgcggcgcatggccgctgcctgtgcctatgcccgcgccaccgctggcatatcgcgccggatcggtgtcgaatttggccttgcatccggtgctgcaaaacaagtacgtgttccccaagtgcgtggagcggtgctccgacgccgccgtgaccgccatgccacacaccggatcgcgcgtcgcggcatcgggctgcgagtggcttgaggacccgcccgcgtcgtcactgccggcatggctggcgtgatggtggtgcttatgcgggccggacgttgtggcacccgccgccatgcctgcgtgctcatgtcctgaagacttgctgggtgaattcatagtgacaagtgccctccgccgttaaccgttggtgtctggtgatcgcagcaggccgcaggcgcgcttgtctccttggcgggtgcggcaccttcctcaccctgacgcgcggcatgatcgtgtccgccgtggccgtgaccacggtgcatgaacaggtgcatcagcggacaagccgccagcagcaggaaggggagatagccggcaacatgtgccgtgtgctccttgagcaggaaatacgcggcgacagcggcgatgatgaggaacgccacgccgtagcgcgatcgccagaaccggggacgatcgctgggggtctgtgtgtgtgctgatgctgcatggcatatctccacggaaaagagttgatggatggtcagagatgcgactgatagaccgtgctactaccgtttttcccgatcagcagcacgtcgtaggcgtccttgcgtccaccataggccggaccatccatgccgggcgaaccgaccggcatgcccggcgccgcgaggccgatggcctgcggggcttcgcgcagcaagcgttgaatgtccgaggcaggcacatgaccctcgatggcatagccgccgatctgcgccgtgtggcacgaaccgtacttctgcgggatgcccagccgcgtgcgcgctgccgtgttcccggtgtcaagaacctgcacatcgaagcctgcgccttgcaggtgtgagacccagtccttgcagcaaccgcagctcgggtccttccacaccttggcgatcggtcggctctgcgccaggctcggtcctgcgagtgccatcaccaacaagccagcgatcaatgcttggcgtctcggcactttgccctggcttctgtcgtagtgcatgttcatagattgcctctcatcagatgatcaaacccacaaggttctagaaccagaatcgcacgccagccacccagcgcgtctgctgcgcgcggccaccttcggcacgcacatagtccgctgtgcgtccgaagctgcccgcccgttccacgccgatgtagggggcgaactggcgactgaattcatagcgcaggcgcaagccagcagacgcttcggccaagcccttgccgataccgcgttccgggtcgtccttgccatagaactgcaattcggcacgaggctccagaatcagtcgctgggtcagcagcagctcgtagctgccttcgacacgcagcgccgtacgtccgccacttcccacgtagcccgtcgcctccagctcgaaccagtagggggcgaggccctggatgccgaaagccaaccattgacggctcgggccttctccgttatccacccgaacgccgagctgggtgtcccagtacggtgcgacggcgtgcccccagagaagctcggtacgcgattcttcgagctttcctttggcgatatcgccttcggccttcacgacggccttgttgtaggtcgtcccataccaagcctggaggtcgtaggccgtggaatcgtcccctttgcgcgtgaagcggcgttccagggtttcgccgcgcaacgagaagaacctgtgttcgtcggccagcatcagccgcggcacaccgggtacggcgtagtcgcccgatcccaatgtcaggccattggagtagccatgcggatcgcgggcgtcaggaggcgccgacccgccctgcatctgcatgttgccgtgatccatggccggggccgcggtcgagccgctcgccgacgtcgcgtgacccgcgtgcgggtcggcggcaggagccacggtctgagtggatggcgcggccgtttgagcgtcggcctggccgtgcgctgcatggtcgttctgtgcttgtgcctgggcggcgacgcttaccagggccagaagcgtcgtggccagtgcgcgagtggggagtgctttggacattcttggtcttccttgtgcgctgggttcaagacaccacgacttcgcggaacatgccggcatccatgtggaacatcaggtggcagtgccacgcccagcggccgagcgcgtcggctgtcaccaggaagctgatgcgttgtgccggctgcaccggcagggtgtggcggcgcgcaaggaagcgaccgtcggggctttccagctcgctccacatgccgtgcaggtgcatgggatgggtcatcatggtgtcgttgtgcagaatgacccgcagccgctcgccgtgtttgaagtgcaccggcgtggactttccgaactccagcccgtccagggaccatgcgtagcgttccatgttgcccgtgaggtgcagttcgacctcccggccagggcctctcttgtccagcggccccgacggggtatgcagatccgcgagggtcaacactcgccgaccgttgttgcgcagtccgatgccggggtcatcgaggttggtgcgcgccatgtcaacgcgcatgtccgtgctggcaccatactcggtgcgagcgtggcgagcagtagtgctgggcacggccagtccccccgccgccgcggcgtgttggctgtgatccatcgccatgccaccgtggttcatggcgccgtgattcatgccagccatcgccccatgatccatcccggacatcgaacccgagcccatcccggtcatcccggtcatgcccgtcatgcccgtcatgcccgtcatctccatggcctggccggacccgccgtggtccatgccccccatcatgctgcccatcatgtcgttcatggtcagccattcgaccggatcgagggcaggcacgggagcttgaagaccttcacgcacggccagcgtggcccgcgcgtagcctgtccggtccatcgcctgggcgaagatcgtgtaagcgtcatcccgtggctggacgatcacatcgacggtttcgcccggaccgaatcggaactcatcgacggtcaccggctccacgtcaacaccatcgacgtgcaccaccgtgagtttcagtccgggaatgcgtacgtcgtagaaggtgttgcccgcaccgttgaccatgcgcagccgcacgcgctcccccggtcggaacaacgccgtccaattgccggcgggggtgacgccgttggccagataggtcagcgtggcggcggacagatcggcgagatccgtcggattcatccgcatctcgttccacatcttgcgcttgtcgatcgcagcggccatgccgtcgcgcgaggcgtcccggaagaagtcgaagacggtaggttggttgtagttgtagtagtcgctttgggacttgagcttggtgaacacccgcatcgggtcttcgtcggtccaatccgagaacagcagcacgtggtcacggtcggcgcggatggtctcggcgccagcggggtcgatgatgatcgccccgtacatgcccgtgagttcctggaagccggagtgcgagtggtaccagtaggagccgctttgctgaaccttgaagcggtacgtgaaggtctcgccgggagcgatgcctttgaagctaatgcccggcacgccatccatctgatacggcaggatgatcccgtgccagtggatggatgtggcttcacgcagcttgttggtcacacggattgtgacggtgtcaccctcgcgccaacgcaatgtcggtgccggcagcgagccgttgatggtcgtagccacgcctggcttgcccgtgaagttcacgggcgattcggcgatcaccaagtcgaactcggtgccttttagcacaggggcggcaccgcgcgtcgcggagccttgctgggcaaatgccttgaacgccggcgtggacagcccagcgagaacgccgccggcggctaacccttggacgaaacgccgacgagaaaggccctgtgggggcacgataaaaaagggtgaacgaggcggcatggcctgaaatcctccatagatgactcggaagtcgttctaaacgccaccccatcctgagcggcacagttcgacgcaatgcaggtcatgctatgggttgggcactttccaccgaatgacccttgaattacattcatgtaatgttcgtgtcatgttcgtggaagctggcaaccagtaaattgctgattgaagtggatgaatgcgtacatcgtgagcggctatttttctgcgccgcagcgatttcatgggacatgcgatgaaactgctggtcgttgaagacgagaacaagacggcggattacgtccgccaaggtctcatggaggcgggattcgtcgtggatctggcgcgcaacggattggacggacaccacctggccatgggcgagacatacgatctggtggtcttggatgtcatgctgccggatgtcgatggctggcgcatcgtgcgtgcccttcgagatgccggtaaacaggtccctgtgctctttctgacggcgcgtggcggtgtagacgaccgtgtcaagggattggaactgggagcggacgactacctcgtcaagccattcgcgttctctgagttgctggcgcgggtgcggacgctgctgcgacgcggaagcgctccgagccagcctgatcgcatccaggttgccgatttggtgctggacttggcgcgccggcgcgcaacgcgcgctggccaacgcatcaatctcaccagcaaggagttcgcgttgcttgagctcctggcccgtcgccagggggaggtccttccacggtctctgatcgcgtcgcaggtatgggacatgaatttcgacagcgacagcaacgtcatcgatgtagccatccgccgtctacgcgcgaagatagacgatgcgttcaatccgaagctcatccacaccgtgcgtggaatgggatacacgctcgatgcgcccgatgatgcccctgcgccataagccgcggcaaagccgtccagcgtcgcttgcattgagggtcacggccctcgttggtatcgccacgaccttggtgtttcttgtgttcaattgggtcattctccggtcgttggagaaccactttgctcaacaggatgcccacgaactggaggcagtgacaaccgctttggctcagcccttgcaccagcttgcaagtgacatcgcaagcgacgaactgaagcaacacttggccaacgcagtcgcaggacatcatgggatgacgtacggcgtctacgatggggctggcaatagcatctatgccacgcccggtcctgacctgtctaaacttgccagtagcaaaaagttggtcaaccgcatcaccgctgacgatttgatcgtgtggcaggaggatcagaggtcatatcgaggtgtggtgctgcaactgcctgctgacgattcagcggcgcccggctaccgcatcgtcgctgccatggacatcggctttcatctcgacttcctggcggagttcaagcgcatgctctggtgggcaaccggcttggtcatgtgcctggcgctcggtgtggcttggctggcggtgcagtggggccacctgccgattcgcaaggtcaatgaagagattcgggcgattcgctcttcaaagctggatgtgaggctggatcctcgggatgtgccgatcgaactggcggaactggtattcgccttcaacgatatgttggcgagaatcgaggaaggcttcacccggctatcacacttttccgcagacatcgcgcacgagttgcgcacgcccgtcaccaacctggtcacgcagactcacgtggcgcttggccagccgcgcagcaacgaggaatacagagaaatcctctattcaaatttggaagagtttgatcggatgggacgcatgattggtgacatgctgtttcttgcccaaacggaaaatgatccccgcaacttgcgtctgtctaccattgatctgtccgaattggtgcggagtctgttcgactatttcgaggcgctggcagaagatagcggcattacgcttggtgttaaaggggcgatcggcagcatagcggcggatcgggaaatgctcacccgggcgctgaacaatcttctctcgaatgcaattcgacacacgcctcgcggcaagagcatcacggtcttgctttcgcaggacgagcagtggacaacgatcagtgtggtcaatcccggtgagagaattcctgagcgcgatctaccaaagctcttcaaccgcttctaccgagttgatccggcacggcaacgaaatacggcgggcgccggtcttggccttgccatcgtgaaatcgattgcggaggcacatggtggctccgttgccgtgacctccagtgagcttgtcaccaggtttgacttggtattgccccatctgcggcagtagtccgagggcgctgcggtccgtccagccaactggcgtatctctttgcctgattctgggatctacccggccggccacgttgctacgcgagcgggacattttttctccgtgactgccacgtgcccagtcctagcggcaggcgccgacatcatgcgcttgtgtatcccatcgctacgtccacaccgcgcgcgggggcctttgctcggtcgtgatccggtcaccgatcgtcgatagcctcagcggtcagtgccgaacgtctgcctgctcggcgcctcgatcgcgcgcagacctggctgtgtgcgctgagcccctgaggtgagttggaagttggtctgctggttcgttgcgcgggtatatgtacccgtagctgggtacagagagtcttattgatcaagatcaaggtactgctatcaggcgccggctgcatatgaacgcagccaaccgccaaaactacctatgcaggtgtccactaaaacttgaccactgcaccccgcccgaaggcttctccgactcgcccgctgacgcgggccaggtcaaccccacaacgacaggcgagaacgccccgccatgccttgcagcgccggtcttgaggcgtggcgtggaagctccatagcgatgccgggcgggttgtccctgaaccgcgttgaggacggcacgcacctgcacaacctgccgcagcaagcgccagcgtgttcgccagcgtcccgtccatcgcggcggggcgctggccgggccgatccggcgcagccggttcggcggcatcgaggggcgccaagcatcgcgcggcggggatagcccgcagggctttcccctggaggcaagcgaagcgcgcagcgccgcaggcgcgaaggcgtgagcaactgtcttgaaagtcaagcctcgcaagcgcgcaggctccattcaattgaagcgttttgccaatgattcaataaatgttgtattatcgaatcatgaacgagacccaagccatttccgccctcggcgccctggcccatacccagcggctgcgcgtgttccgcgccctggtggtcgccggccccgaagggctgacacccagcgtcctcgccgaccagctcgacgtggcccgcaactccctgtccttccacctgaaagaactggcccatgccggcctggtcaccatcgagcagcagggccgcaacctgatctaccgcgccgacttcacccagatgaatgggctgctcggctatctgaccgagcactgctgccagggcggcgcgtgcgaggtcaccgaatcctcctctgcctgtacttcctgctgaaaggatcacccccatgaagcgctttcacgtccacctgcacgtcgatgacctgaaccgcagcatcggcttctattcccaactgttcgccgcgcagcccgcgcgcgtcgaaggcgactacgccaaatggatgctcgaagacccgccggtcaacttcgccatctccacacgtggcaacaagccgggcatcgaccacctgggtatccagaccgacgatgccgaggaattggcggtgctgaaggcccgcgccgaggcggccgacatgacgctgctggacgagggcaccacgacctgctgctacgcgcgcagcgagaagcactggatcaccgatccgcagggcgtggcctgggagcacttccacacgctgggcaacattccggtctttaacgaagcggcgcctgcagcgacttccgccgcagcgtgctgtaccccggtgcgcggcaagccggtgggcgttgcggtgaagccggcttcctcctgctgctgatgtgagatacccatgaccaccgacaagacctacaacgccctgttcatctgcacgggtaactcggcccgctccatcctggccgaaggcatcctcaatgaattgggccaggggcgctttcgcgcctactcggcgggcagccaccccaagggcgaagtccacccactggcgctcgccacgctggagcggctgcacatgccgaccgccggctaccgcagcaagaactgggacgagttcgcggcgcccggtgcgccggagctggatttcatcttcacggtctgcgacaacgccgccggcgaggtctgccccgtgtggccggggcgcccgatgtcggcgcattggggtgtgcctgatcctgcagccgttgaaggcaccgacgagcagaagcgcaaggcgttcacggatgcggcgctgacgctgcgccgacgcatcgaattgttcctgtcgctgccgattcagcgcctggatgccatgtcgctgcagcacgagctgcgcagcattggtacgaagtgaggttggcgcgatgagtgttggaacccaaacggccggccgcgtgccggccgcccccaccatgagcgtcttcgagcgctacctgagcgtgtgggtgctgctgtgcatcgtcgccggtatcgcgctcggccagttcgcgccgggcgtgttccaggccatcggccgcacggaagtggctcaggtcaacctgcccgtgggcctgctgatctgggtgatgatcattcccatgctgctcaaggtggacttcggcgctctcggccaggtcaagcagcactggcgcggcatcggcgtgacgctgttcatcaactgggccgtcaaaccattctcgatggcgttgctggcgtggatcttcatccgccaggtcttcgcgcagtggctccccgccgaccagctcgacagctatgtcgcgggcctgatcttgctggccgccgcaccttgcacagccatggtgttcgtctggagccggctgaccgggggcgatcctgtgttcacgctgtcgcaggtcgcgctgaacgacaccatcatggtgttcgccttcgcgcccatcgtcggcctgctgctgggcctatcgtccatcacggtgccgtgggccacgctgctggtatcggtcggcctgtacatcgtgattcccgtcatcctggcccagttctggcgccgcgccctgctgagcaagggccaagccgccttcgaccgggcgctggagcgcatcgggccgctgtccatcgcggcgctgctgctcacgctggtgctgctgttcgccttccagggcgaggccatcatccgccagccactggtcatcgccatgctggccgttccgatcctgatccaggtgttcttcaactccggcctggcctactggctcaaccgcaaggcgggcgagcagcacagcatcgcttgtccttcggcgctgatcggcgccagcaacttcttcgagcttgccgtagccgccgccatcagcctgttcggcttccagtccggcgccgcgctggccaccgtggtcggcgtgctgatcgaggtgccagtcatgctactggtcgttcggatcgtcaaccaaagcaagggctggtatgagtgcggcccgaaccctgcccgcggataaccaagacacgactcatgagcaacatcaccatttaccacaaccccacctgcggcacgtcgcgcaacgtgctggctctgatccgcaacagcggcgaagagccgaacgttatcgaatacctgaagacaccgcctgaccgcgaaacgctgcaacgcctgatcacggacatgggcgcgccaatgcgcgccgtgctgcgtgagaagggtacgccctatgcggaattgggcctcgatgacccgaagtggggtgacgagcagttgattggcttcatgctccagcaccccatcctcatcaaccggcccatcgtggtgaccccgctgggcacgcgcctgtgccggccctcagaggccgtgctggacatcctgccgcagccgcagcgcggcgcgttccgcaaggaagacggcgaagccgtggtggatgcggagggtcgcagggtctgagacctcccgcacaagcggcaggcaatctgaagtgaggctggtattatcgaatttcgttatcgatattcgatatgaaagagaaacctactccacgtgccatggagcaccacgacctgctgtcggggctgatccgcctgcatgtgctgcaccacgcagccgagcaggagatctacgggcaatggatgatcgacgagctggcccaccacggctaccgcctctcccccggaacgctgtacccgatgctgcacaagatggagcgcgacggctacctcgtctcccgccaggagcgtgaagggcgcaccgtgcgcaagctctacacgatcacgcccaagggcaaggaaggcttggcgctggccaaggaccgcatccgggagttcaccggggaggcgatgcacaaatgacagattccaccaacaccttgcagcatgaggccgctgccgcgcgcggctcacccgtcgaagtcttcggcgccttcctcaagctggggctgacctccttcggcgggccgatcgcgcatctgggctatttccgctcggagttcgtcgagcgtcgccgctggctggatgaccgcagctactccgatctggtcgccctgtgccagttcctgccggggccggccagcagccaggtcggtatggcgctggggttgggccgcgcgggctggctggggctgctggcggcctgggccggattcaccttgccatcggcgattgcgctgatcctgttcgcctttggcatcgccgagtaccaggggctggcccagtccggctgggtgcacgggctcaaggtcgtcgccgtggccatcgtggcgcaagcggtctgggggatggccaagtcgttgtgcccggaccggccgcgcgccgcgctggccattctggcggcgctgctgaccatggtcctgccctcggccgcgggacagcttgccgccatcgcggtggcagggctgctgggctggtggacattgaagatcgcgcaacccggcggcggccacgcccacagctaccccgtctcgcgcaagctgggcatcgtggcgctgctgctgtttgccgcaccgctcgtcgggctgcccctgtgggcggcagccacggactcgtccacgatagccctgctggaaggggtgtaccgctccggtgcactggtcttcggcggtggacacgttgtgctgccgctgctgcaggcctcggtggtgcccagcggcgtcgtgagcaatgccgacttcctggccggctacggtgcggcgcaggccgtgccggggccgctgttcactttctcggcctacctcggcgcggtcgcccacggaccgctgcatggctggatcggcgggctggcactcctgggcacgatcttcctccccgcttttttcatgctggtcggtgcactgccgttctgggaagggctgcgccaccgcgcgggcatccagacggccatggccggcatcaacgccggcgtggtcggtattctggtgtccgccctctatgacccggtatggacgagtgccatccacagcaaggcggattttgggctggcgctgctctcgttcggactgctgacggtggggcgcgtgccgccggcgctcgtggtgctgttagccgggctggtgggctgggtcatggcgatgggcgtctgaatctcatgtggcacaccctgaccatccagctccgacacgaaaccgccgacgacattgccgccatcgaagcggtcacgaccgccgccttcgctgatgcaccacacaccagccacaccgagcaattcatcgtgcgcgccttgcgtgccgccaacgaactgacgctttccatcgtggccgaagaacatgggcgcgtcgtcggtcacgtcgcgctgtcgccagtaacgatcacccatgagcacaggcgaaagaccgagggctggtatgggttggggccgatctccgtcctgccgccaaggcaggggcgaggcatcggttcgcgcctgatggaacaggcgctgtctgaactgcgggctatgcaggccgcaggctgcgtgctgctgggagatccaacgtactacacgcgctttggcttccaggcccatgcgggcttgcaactgccgggcgtgccgcccggctatttcatggcgctggccctgcatgggacagtgccggaaggcatcgcgcactacagcgatgccttcaacgccgccgcctgagccagcgcgaaggcggcggcgttttaattcggctattggccttgaacaccgggcgcggccactgtcgcacccggatttcgcgtccaccgcgcccagggcggaacggcctgggcgcggtgctgatcgcggttattccttcgtctcgatgcgccaccacacaaagcgaagcgccccggtcgaggccggggcgcttgccttcggcgcgggtcaagcggccagtgcctcggcgggttcatccgccattgcctcggtatcctccggggcgtcctgctccgggccttcttcctgcgcggcctcctgcgggccttcggccttgaagatggcgggcatccagccggtgccatcggccagccgctcggcctcgctggcaatgtcggccttcttgagcttcgccagccgggtgacgaattccggtgcaaacgcgcccacggcatccagaatcacggccttggaaacgtgcttgaagtagccttctgcggtcggcttccaccatgcggccatgtcgaggcccacggcctgcgccagttctgcgccgggctggtgcggcgtggcacggggcgtcaccacgtccaccgtggaagccacgcacacggccagcagccgcaccagttcgtcttgcgacttcgccagcagcgcggcgaacagttcggcgctgtcctccggcaaggcttccccggctacctgttgcagttcgcgcagcgccacagcggcgggcgactccggccagtccggggccatgccttccagccggtcttgcactttcaggctcacgcccagcggcaggtcgtggccgtggtagctgtcctgcaaaaccttctgcaccatgccatgcaccagcgcggccagcgcgacgtgcggatgccgggccacttcgatttgcagcgccgccgtgcggtgggcgctcaaccgctgcgccagctggtcggacaggctcgcggccttgggcgggtcgtcggcgtcctcgtgctcctcgttggcggcttcgccttcggtgctgccgaagccgcgccgcagcttttccagcgtgcgcagcgccttggcctcggcttcgcgcagcaggccgcgatgaataacagcctcgccgttgcggtcgatggtgacgatggcaccggccacctcgcgcacttcgggggcgtagccttgcaaggcattctccgcgtcttgcagttctccgaccacctgatcgcgccgctgttccagcttctcggccttggcctcgtcctcggcgtcgcaggcttcttccagttcggcgtcgatcttttcgaggcgggtttccagcgaggcgatgcggcgggcctcgcgggtggtcggctcgcggcggtggcgcggggcgttctggaacgcctgccgttcctcgtaggccagatgcggcacggcctccacccatgcccagccctcggcgcgcacgtcctcggccagcgttgccagcttgtcgcgcacgagcgtttccagcactgcggtatcggtgaggtaggttccggcatcgccttccgcgaacaggtcgcggcggatgccgccgcctgcctgccggtaggcgtccagcccgacgaagcgcaccagcgcgtgcgcggcgtcgatttcgcgctcggtcaggcgctcgcgcagcttggacgggctgcgctgccattccggcgcaccatagaacgtggcttcctgcgcggcgtggtcgtcggcgaagggacacagcaagaccgccccctcacgccacccacgcacgccggttttcggcaagcggagcgcgcaggcacggatcagcgagccgggccggaggcgccagcgatggaagcccgacaggggcgagactcgcgcagcgaggctcaatgcgcagcacgacagcgcgacggcggcacgccgggacgcccgactgcttgggacaggactactcgttgtcggtcttgcgcggctcgatgtgcaactgtccttgacgtgcagccgggcgtagttgcgaaggtacagcgtgtcgtactgcttatcgggcgatgtcaggtgcaccaccatcaggaaggcgggggactgcttttggacggtgatgccctggcgcaccacatcgcgggcagccgggcctgagcctgggcgacgcggttttgtacccgcaccgtcgcgtcatcggcgttgatgccagaacggaaggtgaccgtggtcaccagcacgccgtcggagccggcgacagacttgatgtacatcatgccttcgacgccgttgatctgctcctccaggggtgtcgccacggtctcggcaatcaccttggggttggcgcccggatacacggcgcgcaccacgaccttgggatattcgctgatcggcagcgccgggatcgcgagcaggcccgagacgaagatgacgatcgacagcacagccgcgaagatcggcctgtccatgaagaacttggagaggtccatgggctaataccttgaaaggagtccagggggaagcgcgccgcgccgctcgttgtgtgatacgtccgatcggtggcgcgctccggcgtggtgcttcatttggtggcggacgcgggcgccgcagcagccaccatgggcaccgccgtggcctgcacaggcatgcccggcaagaacaccttctgcgcgccgttgacgatcacgcggtcgcccgccgccagcccccctcgcacgatgcgcagccaatgggaactgccacccagtttcacatcacgtcgctgcgccagtccatccttgtctacgatgtagacgtagttacggtcgtggtcggtcagcaccgccttgtcgtcgatcaacacggccgagaattcgccgctgccgaccagtcgcacgcgggtatagaggcccggcgtgaaaacgcgatccttgttgtccagcaccgcgcgcacggcgatcgtgccgctgccccggtccacctggttgtcgaggaagtccaccgtgccggtgtgagagaagtccgccttgtccgccagggcgatctggaccggcagctggccgcctcgctcgctggggcgctctcccttgcgcgccatgcgcgagtagcgcaggaacgccttctcatcggcctcaaagtaggtatagaccctgtcctggaacacgatggtggttagcacactggctgcatcgctggcggccaccaggttgcctgcggtaaagcgggcacggctggcgcgcccgttgatgggcgagcgcacttgggtcctctccaggttcaactgcgccgtctccaccgcagcctgcgcggcctgcacctcagcctgcgcggactcgtcagcggcgcggcgctgctcccaggcctcggtggagacagcctgctgctcgaccagcaccttggcacgttgcgcctcgcttctgctgcggccggcttcgctgcgcgcccgggtcaattgcgcctgggcccgggccagttccgcgcggtagcttcgggcatcgatcatgaagagcacatcgcccttcttgacctcgtctccttcgcgataggcgacccgctcgacgtagccagacacccgtgggcgcagctcgacgctctcgatggcttcgatgcgtccgttgtattcgtcccattacgtgatgggcttgatctcgacctgcgcgacgctgacttgcggcggcggtggatggcctccggcgccagctccggcgttctctttacaacctgcgagcgccatcgcgctgagggagatcagtatccaaagcaggcgcacgccgcgagggtcggagctggaagtcgtcatctgaacaggttccgtggtcaggtcgtaaagcgaatgaagcgagcgcgatcgcgctgcacgctgtcccctgacgctgctttcttggcagcgcaagaccatgagcgacagatgcggcagagatcgaatcccgttggttgtcggcttctcgtctcgtcgcagaacgcgcgcgcaaaccgacctcggcggcattacaaagcctcaaaacttgaggtcaagcgatatcgacgttctgattcgcgccgttgcggattggtccgccgcgtcgcatttttggacggctcttgagccgccggttacgcgagaagtgacaagtaaggattgttcggtggtggctctgcgaacaggagccgaacatcgtgcaatagatagccatacaggcggcgggacttcctggggcctgtgacatcgcacgtccagatgttcaggcccctgggctttttgcgatgcagttgcaggcgctcgaagcgcttttgtacccattgccaatcctgctggttctcctgcttggcgagagtcccgacctgggggtgttcttgtgcgtagcgttggaataccccggggctgaccaggtaggccgtgtcgcccaccgtatgcacgagcgccttcgcgtcgttgatgaccagccggcgggtagcgataccttgtttcagccacgccatgaagtgctcgcccgatggctgcgccgacgaggacgtgggcaccggcgctgatgacggcacgggcaccatcgaggttggcggtggcgtttgagggccagcggcgggtgcgtcgcccgagacggcttccgcatcctgttggggaacaagcaaatcgccgattcctaccatcgccagcaggtcctccatgacatcgggtgcggcttgtgcggcaggcaagtgaaccggagtcgcggcgtcgacgccctcccatggaagggactcttgatcgtcggtggctggctttgccgtcattgccggcgagggcaccaaggcatcggcattgttgggtgccggtgtcccgtcgattgccactgcccctgcgaagggcgctggccgctctccagactcccaaatcagcgcgggagcgagacgcagcagggtgaatgagtgggaccagccagtcgtgctggtcacggtcgcgcgccagaccgccttgccgtccggcgtcggttgcaacatgccgtgatcctgcagcacgttgaagacggcggtgttgctcgcggggatgccgtcgacgcctagtgacagcaggtgcgcacgcagcttgtccgagaccgtcttgcttaccagccacaaggcatcctcggtgatccagccatcggaggcttccggctggttcagcttcaactgttccttgagcaggtagcgcagcccgtcgagcaacttgcgctgcagcgcatgcttgtgtgcagccatggcgcgggccggatcgccgcccagttcctgggccaccgaagcccggtcggcctgcacgacaagttcgcccagcacgccggcgcgctcgtactggccggccaggacgtagagcagcggtccccacaggtcgggatagccactgagccagtccagggcatcacggtcgagcagttgacggtagagtaaacctgtcgcggcgctgtggagccgatattcccgatcgtcgcggtagcggaagcggtatggctggtgcagcgggccgtgccaggggtgccacagcgagccgtcggacagttcgacgtgcagatcgacggcgatcttgccgatgtcgtgcagcagcgcggcataagcgactgcggcagtccaggcttcagactgcgccgcctggtcttcgggactgccgccaatgggcagcagatgggactgccgcagcttgagcgcataggcgacgatctccaacccgtgatccagcatgccgccggggtaagcgtggtgatggctttccgatgcggggaattgttggaccaactcggcgtagtgctccagcggcgtgcggtatagggtggcgaactgccgccgcgacagcgacgtgcgctgccagatgtgttccagcagcttctgccggcgcggtgttgccagcagcgatgcggccgattcgggccgcagcaaccctttcgggaggtcggtggcgggcgctggcgacggggcagcgaccgggggccgttttcgctggaacagggagagcatgcgggtgtcctctggggggccggccgggaggccttttcgccttttcgaggtagggcctttccccttgcaccccattcccttgccgtttcggccctttggcctttaaccgtttcggtatagccgggcctgggttgcgtctccagcgtcaatgtggaacccgcacgaatggattggacggagacctggcgctggcccctgcctatgctgcggggacgctacccccggcaggtaggctctcgctcaggcgactaagttgacaaatgcgacaagggcgactagagtgaatcctgtctcaaacctgcttgggagatgaccatgcccaccgccattgaattcattgccgatcgtctgccgcgcgtcaccgtggaggacgtgcgccgtttcgcggataccgttgaaatccgggatgcgccggctttcgcggccgagttgcaggcgttcattcacgagcgcgtggaggcggtaaaactgccagccaacctcgaaggcgaaacggtggagcaggccctggcgcgcaaggcggccgcgctgcgcaccgaaacgcgctggaccccgactgaaaccgacgtccagcgaggccgcgccgtgttgctggaatccttcaaccagccgcacaacctgccgatccccgagtacgccaagctggcggacaagtcgcgccagcagatctacaaggacatcctcgcgcgccggctgctggcgctgaatgtggggccgcgcggccagaagctgcccgactggcagctcgacccggtgaagcagcagttgacccaaaccgtgcttcaagaggtcgagggcatcgaccactggacgatctaccgcgcactatccgaaccgctcgaaggcttgggcggacgctcgccggtggatgcggtgacgcatggcacaatcgatgacgtggccgaagcggtgttcaacgtgctgggcgtccaggtgcattgaggcaagaccgccatgagccgcgaactgcccttgttcttgatcgatgcgggtgaactgctccagcatgtgagccgcgtcgtctatcggggcagcccgctgtactatggccgcagcggcaccaatcgctacgacgacccggcgcggacctacggcgtgctctacctgggccgcgacctgtccacggcgctgatggagtcggtgtttcacaagcaccagtggctggcggacgagaagcgctcgattgcgctgaaggaagtcgagagccggctcgtgcgggccgtgggggtcctggacgacgtgcgcttggccgatctcacggccgagggtgtcatggcgggttacttcggcctgaacctggaacagttggccagccgcgactacacgcacacgcagcaggtgtccgcccaggtgcatgcgatgctcggcgatgatggccagccgctgttcgacggggtgctctatccgtcgcgcaacaactatcccgccaagagcatcgccctgttcgagcgtgcggcagcaagagtcggcgttgtcgatgacatcgacctggtggaccatgtggactggccgcgcttcgttgccacgtatcgcgtcggcgtggagcctgatcccgggccggtggaaccggatgacgaagcgtcctgaagcggcaagagagcacattgaagccccaaacagaatgaaatggaccaaactggaataggcatccctctgtagcaggagacgaccatgaacaccacgacccgcatcagcaccgcagaacgcctcggccgcacctttggccgcggatggcgcgcctacgcgcgcggcgaacgtcgggcgtcgaactggttggtgtccaagggggtgccggcggccgttgccaccgcgctcgtgtgggtggtcaagctgtctgtggtgggattgctgctctacgttgctttttggttcgcactcgtgttgttgggcgtcgtggcggcggcgtgggctgctgctgccaatacctctgacgaggacgagtggcctttcaccgatctcacagaactgcgcaagacaccgggctacgatcccaatctgtacaacgatacgtcgcacgagttgtacaccgacgactgacggactccgggctacttcagcttgcctcccgtgagtgccccagcccccttgcccccggcttggccggcgctcttgctgccgtccgacaacccctgaatggcatgtcccgcccgaattccaacccaggtcaggcttgccagccagaatcctggcagcaccaggaacatcgtgcccgcgacgaacatcaagagcatgtcgccgaacgcattgttcagccccaccagcgggtcgaagttcgtgtgtggccggttccagccaaagccccagccatagagcgcatcgaggatagtgctgtcgatccagcgagcgagctggaaccagaaatccacgaagaacagcgcgaattgcacgacgctgaccgtgacgaccgtcttcaggtcataggtgcccacgaccagcacgagcgggatgcagatgaccagcgccatcttgagcaaggcgaggaccatgggtagagactgtctcacgacgtccatggcgggaaacgcggcaatcgcgccgacggccatcccaacgtctcccgtggcccgtgtcacgatgttcggcaaggtcttgtcgatctggcctccgtagtccgtatagacgctgccctggttcaacttctgctgccgcggtgacgcgatggctcggatcaccgagtcgtccacctcggcccggctcaggaacccggcccagcccgccaggcgactcaacaggctcgggtccacctgacccagcaggcgtgcccgcaggccgttacttccatcgctccaccactggcggcaggtcgggtagccgccaccgctggccacctgcgcaagccctgcgtcgcgggtgctgtcatagggccagtcctcgcgtggggtgctggaacggtatgtgtcgtagtagccgttcgtgtcggtgaagaaccgcgatccgatccaggtcacgtcgtgcatctgctgctcatcgagctgagggcgctgcatgaacaatttggcccgtgcaggcccatagcaatcccgcgagaaatccgctacttcctgagccagcaccgggtcatcgatgcgcgtagcgtcgatctccatgcgcatctgccgcaggtccgtgccgcacgggatcgctgccaccgaagcgcccgtgacggcgcgcgagagcgcgtgcatgaacgcccaccacaccggcaccttcgccgactggttgttgatggtgctgaaggactgcgaccagccggtatccccgggctgcgccacgctgacctggcactgggccgagcgcgagctgtcgtactggatggtgttcaggtccacgtcgatgaacggaatgccggcgaacatcaccaccacgatggcgacgaagacccggttctcgatgcgggcggcgctcagcacgcctttgttgccctcgtcggcgccttccgcacgggccttcaaccactcctgcacgatgatggcgacgaaaggcagcgcgaataccccgctggatacgaggaccgcccagatgccgttgttgacgatccaggacacgagggttaggtagtactccaggtagtcggtcgtgaaaagcgtcatggcctcgatcccctcaagcggcctgcatcaacaggctggcttccagcgccacgatggcaacaatgccggcgacctcagcgcgaatcagccggcgtcgggccagcgtgctgtcctcgcgcgccagcagccgccgccgcatccagacccagccgcaggccgtcgccccgtacaggaacaaccgccacacgaagaagtagcccgatgcggccgcgagccaccgctcccagccggccacgctgccaacgagatagatgccggcgatgttggcgcccaccgcagcggcgacgatcacggccgcccacagcagtgctttcgccgcacgccggctgatgagccagcgcaaggggcgccaggccatgcgctccgcgctcatggccggcctcccggattgcccttctgcaactggtcgaggcggtcgggcaccggatcgccctcatagatgccgcgcgagcctgccgcgcgcgtgccatggcgctggatgatggccatcggcgagttgttcgccagctcgcgccgcagttcaagttcggtcttgaggttgcggatctcccggtcgagcgtgtcgctctcgtggttcacggcctcgactgccaactcgttggctgccacgttgggctctttcttgccggtgagcagcgtgcgctggagcagcagtgccttctccagcaccgacgaaagcgccacctcggacgcgaggcgccgcgccagcaggtcctggtccggctcgtcgcgcagcgcctcgatgacgccgcgcgtgatcggcagcgacgtgctgccggcctcgcgcaagttctcgaaggtggtgttgcgcacgccggaaaccagttcctgcaagacttccagcttggcttcgtactcctcctggatcagcggcgtcagcccgacgccgggcaccgtctcggtcttggtgcaggaatcgcacgtgcgctgcacctgttccccgaggacccgggtggcccattcggtcgcctgctgcggcgacgtccaggtctggcaggacaggctcgcgcaactggtggacgcgatggaggatgtgtccgtcacgccgcgcccgttgaccaggttgtagcccgcgcgggtgacgtcgccgaccacgcggatggcggactggcctgcgccaccggcattgctgccgcccacccagggaaggccgtcgttgccgcggcgcgtctcggcctgctcgacggccgacacggcatcgttgctgccaaccgcgtcacgcaaggccatgccttcggccatctggctccagccaagctggccacccgcagtctcggccatcttctccgccatggcgcggcacgtcagcttggagcggtcgaagtccagccgcgcctgcagcacgccgttggtcagcaggttgtacaggcccggatcggcgcgctgaatgatcagcgccggcagcgatgcaaccgcgctggtcgcgctctggatcacgttgctcatgatctgctgaaagccgttcgtgatgccgttgagctgattgcgcagcgtggtctggatgctcatgtcgccgcagatcaggttgctgttccaccccacgccgaccccgatggagcgcatgccggccgcgcggcccatggacaccgcactgccaccgccgatcgagtacatgacgtcatcgccgaggacggggccgctgttctggtatccgacctgcgcccacgccaggccgcagaccagagcgagcgggccggccagcgccttcgggcgcagcaggcggcacgccttggcggaaaggttcatcgattcaggacgcttcatcgtggcacctcagaggaaatcgacgctgcccaggaacacctgcccgcggcgttcgcagcacgcatagggacgccacagcgcccaggcgtagtcgccttgttgggcctgggtcagcgtgccgctgtgcgggaacaccacgcaggtgttggacaggcgcggcgtcagctcctgccacttgcccgtagaggcatcaccctccatcagcgcgccggccggccagtagccgtcgcgggcgttggcaagcagcggctggtacacgtggatctgcccgcggcgcgtgacgacatcaccggcgcgctgggccacgacggccccggatttgtagtcatcggtctgatgcaggaagccgccgcgcggatagacattgccccagaggttcatcgtggtgcgcgcaccgacctcgcgcatgcccggaatcaacgcctccgggtaggccatttcaggcacgttgtagcgccaagccagcgtgtccagggtgctgagtagatacggcatgaaggccgtgcccgcgccttggcagaaatagcccgacgacgatgcgaactggttgaatacctcgccgccaggatggccgatgacatcgctgttcttgaatttggcgaggttgttgtcgtggtcttcgttcgtggtcccatccccacctgcctgtgcggatgggttgggcgtgctcatcgcctgcacctcgacccaggggttctctccggtgttgctgtagctggagacgaccgcatcgggcacgtagtgccggaccttggtggatgtgcgcaccgtgcagcccgtccaggtgcagtagagccagtagcagatgcccaccacccggtactccaggcagtccggcgacatgacggaggacacgatggtggcggtgttcaaggcgtagctgcccgtggcgctgatcagcagcagcgaggccacggcgacgcgcaggcggcgcagcaggtcgaatgggcgatgggtcacggctgcgtcctccggtgttgctcgatgcgcgcgacggcccgggccacgtccggctcgccatagaccacaaagcgttgatccaccacgacggccgggatggtcgtgacacccaaactccatgcgtcggtgacgccctggtaggcggtgccgatgcggcgctgaagatcggtgccgccttgcttcaggcgttgccggacgatggctgctgcccgctcagggtcggctggaagattcgcggaaagctcggcctcgatccggggcgtttcgcccaactcgatcagtcgctcgccgcccatggtcttgaccgggtggcggctgtcggtgacgaccaccacgtcggcggcgaaggtggccgggctgaacaccgccagagacgtcggcagcgccacggccaggccaagggttcgccagcctggtgcgaaccgggtaaaagctgctggcatgtcatgtgccccggaagttgatcagggccatagtcaaacgccgaaccccaggcggccccaacaaacaatgcgcatcgcggccaccccgcatacctgcttgcgtcgccgcaaagaaaaaagcggaggccgaagcctccgcgctgatcaacgaagcagtgcaacccttacagcaggccggactccgcaaaggagaacggggcaccctggccgacgatgatgtggtccagtacccgcacatcgatgagcgccagcgcggcctgcagttgctgggtcagcatgcgatccgcgctcgacggctcggaaatgcccgaggggtgctggtgcgcgaagaccaccgcggcggccttcaactccagcacacgctgcacgacgacacgcggatagaccgaagtcgagttgatcgtgcccctgaacaacggctcgtaggccagcacctggtgcatgctgtccaggaacaccgcggcgaatatctcattgggctcggcgaccagcttcacgcgcaggtagtcgcgcacggccgtggggtcgaggagtttcgcacccgctttgaaaacccgcttctccagcagtgcaatggcttgctggatgatccagtcctcgtgttgggcagcgatggcggaaagcgactccaggcaggagtcattgacgacgaaagacatggcgaacctccagacggtgagatcggagggcgcgcgccctgggagggcaagccctcctggggaacgaacaaggtgcatccatcaccgcggcagcggtgatcgttcgcggccaggatgcgaggcgaacgggtttcggtcagcgcagtggactgcgccgtagccttgaagaccggggctacctgggcatgtcgccgacgacgtcggcaggcatttccgatgtagtaggtgtggcggcgggatcgccggccgcgagcatgtccatggccgacagcaaggcatcgccctcgatcggaccctgcagtaggatcgccttgccggtttcgcgatcgtgcagccgcagcgacggcgtggcggtcacgccgctgctcgtggcttccgccgtctgggtgcggatcggcgcctcgggccgttcgctcgccagacactgctcgatggctggcgtaaggtcggggtaccgcaggtcctcgggcaagccctggccgtcgctgcgcgtgtgggcatagacccactcgacagcctgccagaaggcggcatggccgccagattcgccggcgcactccgccaggctcgcttcggcagacgcggccggctcatgcgcggccaacgggaggtggtgccattgcaaggccacgtccgcgttgccggccacccaacgcttgagcactgggaaataggatcggcagaacgggcattcgaggtccgcgtagagcgtcagcgtgaaacgcccttccggatttcccatctgccacggaggcccggccacctgcgtcacgctgaccggcgttgaagtctggggagtggacttgccagaatagcgggacacgagccagatcagcagcagcgctaccagcacggcggccaacacccagggccagctgagcctccagcgccgacggcggaacgcctgtacctgcatcggaatggatgggcgtttctgttccatggcgttctccggtgtacggcagattcagggcaggtccagggtcggcgactcgatgccacgtgcccggtcgatcttctcagccaccttgaaggcggcatccagctcgctgacgccgtgctgctgcatgagctggtagcgttctgccttctcctcgggctcggtttgcgcgagcgcgaggtagagacttggcggcacggcgcggaacagcacttccatgctcttggagaggatgacgccctcggtgaacttgcccgcttccttgcgtgcggagagcatcagcgccttctgcgccggcgagagttcgcggaacctggcgatcttctccacttcgtccggcggcatcgacaggcacacccaccactcgatcatgttgagcatgggctctgcggcgcgcggcagatcgtcgatgttttgcgtcgccagccagaaccaggcgcccaacttgcgccacatttttgtaattttcacgacatagggcgcgagcagcgggttcttggtgatgatgtgaccttcgtcggtcacgttgacgatcggccggcccaggtactggtcgcgctcggcgatgttgttcaccgtgctgatcaggctgatgtaggcgatggagagctgcgcgttgtagccctcgcgggcataggtcgccagatcgaccagcgtgatgtcggcctcgggccacggcgtgccgtcacggtcgaacatctcgccgtccgtgccttggcagaacatgtccatcgcgtccgccatctccagcagccgcacgcgccgcatctcgggcagcgtcgggtcctggccacgggcgcgcagcgcgttgcgcacgtcgcgcgtgagcacggtgcgcttttcggccacgcaatgttcggcggcgtcgaggatgcactggcggatcagcgagcggtcggcccgcgtcatccgcgcttcttccttgtcttcgccgcccgtgatcatcagccgcgctgtgatctccagttcgcccagcacgtcgcgctgctcgtccgcttccatggccgaggcatcggggggcaggtcttcgtccagcgcgtcggcatcgagcgtctgtacgtcgctgggcgtttcgatcagccggcgtgcgtcggcgaacggcgccaggctgatgcccgatccgggggccagcttgacccggttcacggtcaggcccaggcgcctggcgaagtcgctgaacaggccgaagctgttgccggcttccacgatgaaaagccgcggccggtagatggccgtcacctggttcagcaggttgttgagcgtggcggacttccccgagccggtggggccaaatagaaacagatgggcattcatctgccgatccaacctgttcaaggggtcgaacgtaatcgggccgccgccgcgattgaacatcgtgatgccgggatgccccgtgccctgggcgcggccccatactggcgacaggttcgccgcgtgctgggcgaacatcagttgcgtgtaccaccggcgccggtccttgccggggttgtagcagcacggcagccagcgcaggtagctgttgagcggcgccacctcgtcgtcctcgcgcaccggctgcaggccggcgttgagcatcacgttcgcgaggtccaggccgcgccgatccagttccgcctcgtcgcgcccgcgtaggtagaacgccagagtgccccggtagagcttgtgcgcgctgccgatcagggagcgggcttcatgcacgtccttgagcgtctgctccgacgccagcgtctcgcccacagctttcttcgccagatggttgaggtccgattcgaggacgtcctgcggcgtggccaccatggtgagacacatcaaggtgtcctcgggcatctggtcgaacagcgtgttgatcgcgtcccccttgcgggtctcgccggtcaggtgcccggtgccgggcggcatgcgcagccggtcggtgatcagcacgcggtgcggcatgccgtcgaagtaccaggccccttgcgccacgtccgagcgcggctgcccaaagaacagccgctggctgaaatcccgcccgctcgccagctcgatctcgccggcctcgctttcctcggtactgtccggatagcgcgccaacgcgtagaagcgctcccggtcctccaccccaggcccgagcagcgtggggcgcgggttgaaccaccgcagcagccagtcgtggacgtcggccgcgaccatgcgccgggcctggatgccggcgttcgccaggccgccgcacaggcggtcgcagacgatgcccagcatctgctcgggtgtctggccgcggcggtttgcctgtccctgtccgctcgcgcggcggtacaccaccatgcgcacgcgccgcgtctggccgcgccagcgcagccgcgtgaccaccgtgtcctcgaacaggccgccgggcttggccacagcgcgcaggtggtggccgaagaagcgcaggtagaactcggtgaacgccgagccgcgcgcacgtggctgcacgtaatcgcgcaaggtctgcatgtactggtcgaagctcggttcgtcctgggcatagagctggagcacccacgggttctcgtccagttcatcgaagctgtcctgaagcgcgttttccagggcgtcgcgggcatgcgcgagccagccgggttcccggccttcggtgcccagcggcaccagctcgtagaaggcggccaccgattggccgtcctccaggagcatcgatttcgactcgggcaagaactccacccagggcagcagttccacgaaggacggtgcgacgtcgtacagcgcctgctcgtcggccacggtcgccggcttgcggccctggaccgcggcgccgggttcggggatgccggcttgctgcaaggcctcgacgtggcgctgccagccgtccggctgctcgtcggcggcggtgtcttcggcgctgacggcagccagcttcggccatggaagtttccaccgcatcagtagtcctccgtcctctcgccaggcatcgcgtactgcacgcgctggtacaaggggaaaaccgtcgtgtagcccggcacgggaacggggtcggtgccggccaggtgcgggtacacgtacatcacgagatcgggattgggcagacgctggaactggcggtgaacctcattgcgcgcggtgcgcgtgtagcgcatctgctcgacaggtgcggcctgcacgtcggcgtcggtcaggggccgacgcaggctctggcgcgcatcgagcaactggcggccggcgttccgtccggctgcgccaccgccgtcgccggcctcctgctgccagatgtccatcatcgtgcggtcaccgtgggtcaacagcttttccttgctggtggcgcagccggcgagcaccgcgacggcgagggccagtgctaggccacgggccaggttagtcaagttcaagggcatggctttctcctgcgcggtgatcgaccttgcggccttcgggatcgaagtcgatggcgagcggcttttcgaggtggacggcaaccttggcgccgggttggacatagacggcggcgaaggcttggccgtagagcttgttgacccaggccgacatgtcccggacaccgcccgcgagaatctggccgaccgcttcttggccggtgatgcccacggtgccgatggagccgtccgagccgacataggacatgcggccgctgccactctcgatgagcgaggccacaccggcaccggccgcggtgattagggcctgcgagccgaggtattgctgggcgttgctgcgccgctcgccgctgacgcaaggaatgccgtggggatcgctgatccagcccaagccgtcgcgctgttggttgttctgctggttgccctcgcggtcttcggggatcgtgcgaatcgtgccgtcgttgaagacgaacgtgatgctgcgcacctgacctcgcacgcacgagagcgtccagtcgcccgaggcggtgccgctgaacacggcgccggccacgtcgggaatgtcgatgccattggcggtcaggttgtccggcccgaccagaactttgaacggatagggatcgttgaccgtgccgtcgatcggcacgcggccgatcagggccgtcatcgccaccgatcccattagcgtcgagttggtcggcacggtatagaccggcttggcattcttgaccccggcggcgcgggcgcccgcgttggccacggtttcagcggtggtttcgagcgtgctctgcgccgggccgaagctcgtggggaagctcatgccgccgctcgcgccacgccccccgttgcgcccctcggcgggctttgcgtcgtccggctcgacccaccgcacgccgccctccatgccggcctcgtcgccgccctgcagccccaggcccacgggcaggtccgcatggccgccgccgcgcccgccgatgctgtccaggcgccgctgcaggtcggcgagcagcccttcggtctgctggcgcgcgctggccgcctgctcttggtcgcggcgcaggttggaccgctcggattcgagcgccgagttgatgcgctggtcgatggagttctcgcgctggcgcagccgctggttctcttcacgctgcgacttgttgtccgagagcgcggtctgaagctcggtgcgcaactgcttcacttgggcaacgagcgtcgccacggtgtcgcgcggggtgtcgccttcgatgcccagcgccttcatttcctcgggcgtgagctgggcgccgttgtccgccgcgggtggcgccgtgccgcctccacccgagaacagccggataccggcgaacagcaccaggatggcgacagggatcatcagccacttgagcaggccgttactgcgcatggcgggcctccttggcgttctcgtcgccgtccggctgcggcagatgcacggcagggtcgaagcggtgaatcgccggcagcagcgactgcgcgaggccgcggccgcgcgtgaccaggtacagcacggtcgtgtcctcggtcgtgccgcgcgggcccagcgcctcgtgctggaaggtggcggtgaggaaatcgccttgcagcacgcgcgggtcgagcgcgacccagtcggcgccggtgttggtgaggcgcacggcagtcacccattggtcttccaggcgccacgacgcgagcacggccgcgcgcaccggcagcgttggcatcagtgtgtccaggtcgaggtcgcggggaaggttgacccgcatgacgcccggaagcggctcgacggtgcgcagcggtgcgtagaggttctgcgcggcgaagcgcgtcagcacgacagggaccggagtttcgcgccgcgcggtccgcgcacctgcctggccctgggcgcgtgccggggcctcggcactgtcggcctgctcgccatagcgtcccggtgcgctgtcaccctcgacgatgcgcaccggctccagctcggcttccccgtccttgggcggttcggctgcgatgtccagcaggatcagcgcgcccgtgtcggcgtcctgcagttgcaaccgcgtgggctcgatcggctcgctggcacgcaggtacaccgcgccgcccgcactctgcacgcgcaggcgtttgcccacgcctgcgggcacgcccacgcgcacgttccggtcgatgaatacgatgcgttcctgaccgaccttcagcggcactgccagtggcatgcgttcccaacgcaggatctccaccgcctgggcgacgggtgccgcggccacggccagtagccccagcagcgcgagtacaggatgcttcatggggtgtttcctccttgaggcgcttgcggattcaggtcactcggcgccgggcgcgccggctccggtgcactgatgcgctggggcgcgccttcgtagcagtccagcgccaggccgaacgggttgcgggcgggatcgacgtccacccgcgtgaccttgatcggatagcgcaccagggcgcgtttgacctgctcggcgccgtagtactcgtccgccgtgatgtccagcgtcaccacccagtcgcgatcggatacggtgcgcacgcgcgccgtggggtcgtcgccatagccgcggccgggaatctcgtagatgccgcgcacgcgctgacgcagctcgcccgtggagcggcggtagtcatagtccgcccgcaggaaggcctggcaggacggggtgaggtacggcgagagcgtatggaggttgcgcgagtagtcttcttcgccattggtcggccagcggttcagcgtctggaacacgtagaacgtgaacgcatagaccgattcgggcggcacttcccaccacttgcgggtactgccagagcgcaggtcgggcgggacgtggatggtcaggtcgcgcggcgcgctccaccagccgccgcccatgaccagggcgacaatgaccagcgcgcccgcgcccaggcgcaaggtcttgatgtgcgcctgcaggtgggcgatctcgttcttgaagcggctcatcgcatgctcctgcgggtggaccagaagcccgagcgcgagatcagcacgtggccgcccacccagccggccatcagcggatggcgcgttgcgatgcgccactgcaactgtcgatacagccaggtgtcggggcgcccacgcttgaggcggcgcaggatgccgccgccgatgaacacgcccaaggccacgcccaggacaacgaacgtcggtgcgatggcgatcgtgcggaacacccacgaaagcggcgcgccgaccagcaggccggccgcgccggacaggccgcagcagatccacagctcgtcggcggtgaggccgcgcacgaccacgggatggcggttgagccggtgcggaaggaacgtgaccgtcccgtccgcacggacgtgctgctgctcggacataccggcctcgcttacaggatgccggtggcttcggtgagcagccagatgccgatcacgagcagcacggcgccgatggcgaccgtgaggccgaattggccccacgtcttgcggccggtgtggatctccgcgtaggtgccgtaggcgtggtagcagacgccgatgaacatcgacgccaccaccagcagggccacgagcatgatgatgtcgtagccgtagttgcggatggtctccatgatgccgttgccggtgccgcgcgtcgggttctccaactgcggcagaccttgcgcgaacgacagtgcgggcagcgcggcggcgcccagggccacggcggcgcgctgggcaaaacgggaagtgaggttgcggttgtgcatggtcgggcctttcatgtcaggacaggaggaagaaactcaggacgaggtacatcgcgacgaagcggatgcagacgccgaggaactggcgctggttgaggcggctctcggaccaccccacataggccgttcggatggcccagacgccccacacgagcaggaccgcgaacacgacgccgaccaggacggtcgccatcgcggaaggcgcgataccgctgttggcttgaaatgccgagacctgggcgccgttcattgctcgccctccgcagtcgtcttcggcgatggcgaagcggcccgctcggtgcggtagtcgccggccagttcggaggggtcgcgcggctgagcgcgtgatggcgtcaggtggaactggatgccggcgcgcacgcgcgccaggtcagccagcagccgtgggtaatcgaagtggtagcgctcgcccggctggatgggggcatgcgcggcgctgtccgcgacggtgcgttccagcgcgtcgagctggcgcagcgcggcgaccaactcctggcgctgcgccggggactcggccaatgccatcggggactggcccagcacgagggccgtcacgaaacaagtgggcacgccgcgatgcgcggcgcgcagccagatcgaagccaccatcgcgccattcctgtgtgatcagcaatgggttgatcgtggagatcagggctgtttcaggccgcaaacaataggaactggcggacgaccggattgggcatgctgcgagcgaacctacaaaagcacgggtcgcgcttcgattattgcgtttttcgagtatttcgaatatgatcggctctgcaaccgttttcgcttaggagctacccatgaccaccgccactgcccaatccaagatgacccttcccgccgcgggagaggtgaaggcagccgtccagggtcaacgtgccttggcggcttacctcgcaacccagttcgagacgcagcacatccagatctttgatgaccacaaacaggctcatcaggtggaactgcctacctcggctttacgcctgctggtcgacatcctggccgagttggccgatggcaatgcagtaaaggtggtgcccgtccatgcagagctgacgacccaagaggcggcggacttgctcaacgtgtcccgtccccatttcgtcaagctgctcgaagatggggtgttggcatttcatcgcaccggcaagcaccgcagggtgaggttcgccgatctgatgcagtacaaggaagcgcgcgagcgcgccagtgagcaggcgatggccgaactcgctcagcagtcgcaagagttgggaatgggatacgaatgaggcattccccattcaccgccgtctacgacgcgtgcgttctatatcccgcgccactgcgggatttcctgatgtggctcggcctgtctggccgcttccgggcgcggtggagccaagccattcatgaggagtggaaacgcaacctgttgatcaaccgccccgatctcacccgggttcaggtcgacaggacgtcggatctcatggaccgggcaattccggacggcttggtggagggctacgaagcgctcgtggcaggcctgacattgcccgatccggacgaccggcacgtcctggctgcggcgattcgctgcggtgcgagcgtgattgtgacgttcaacgaacgggatttcccgaacgatctgctggctccgtacggcatcgaatcgcagcaccccgatgagtttgtggacaacctactggatctggacgcggccgccgtggtgtcggctgcgcagcgccagcgtgcccaactcaagcatccgccgatcgaggtggaccgctatctcgaaatcctgctgcgccagggccttgtgcaaacgaccaaggtgctggcgacctatcgcaccattctctgacccgccgagagccacggatgaccaagaatccttcatcagacgccactttgccgaaaggcatccatcgaagctggaagctgccggacacgtcgctgggcgccctgtgggattccatcgtcatggacgaagctctcaagaagcagttgctgtcacaggcgatcgtcaacttcacggtgcgccccaaggtggagcgcacggtactccccctgcacggcgtgatcttgttggtcggcccgccggggactgggaagacctccttggcacggggcttggcgcatcgtgtggccgaatctttttcttctgcgaagtttcgattgctggaagtagagcctcacacgctgacgagctctgcaatgggaaagactcaacgcgccgtggcagacctgttctcgcaatcgatcgcagaatccgcagcggcgggcccgacgatcgtccttctggacgaggtcgaaacgcttgcggctgatcgagccaagctcagcctggaagccaacccggttgatgtgcaccgggccaccgacgcggtgttggtgcagttggacatgttggccgaacgcaacccgcatctgctgttcgtggccaccagcaacttcccacaggccgtcgacagtgccttcctatctcgttgcgacatggtgatggaggtgccactgcccggcaaggatgcctgcaagcagatcctggtggactgcctgaatggcctggcaaagacatttccggggattggcaagctttcctcggctcaccagttcgacgcgtgcgctggcgagtgcgtcggattggatggtcgggccattcgcaaggtcgtagccaacgccctcgcggccgacccgcaagtggctatcgatccgaacaagctttccgtagagcacctgcgcagtgcgatacgacaggcaacgcaaatgcgccttcaaggagggaagcaaaaatgaccaccgttgtcagccggacgtttcgcagctcgccgcaccgcgatgcgttgcagacgtgggatgccattgtcgaactgctcactcagggcaaggacggcacggctcgctctgaactcagggccgtggcgggcgtggccgccagcttgatcgccgaccaggcacccaagagcgcgcccatcgttgcgacatgcgatggaccacggaccaggatctactgcctcttcgacgaagacgcgatcgatggtgatgatgccaacgaagaagtcttggggttcgagccgttgaagggagactggggagtctcgctgccgtgtccgaaggagcagctcggctgggtgcaaaccgcgctcaaaaagcacagttctcgcatcattgcacgggacttgagccaaggaattgccacgcaggcgcaggccgatgctggacaagcgctgtcgctcgacctcggaggtttcctcaagtcatgagcaccgtcgccacctactcgtacacgcactcggttacctatgtgaccgacaacatcctcaagagcttgaaagacatcatcctgctcagtgggctggaccccgagcacttcgcggatcgctgggagagcaatacccgagccatcaagacgtggctcgggaccggtgatctgcgcaaggtgattctggagatctacaacccggcaaccgacaaactcgtgacccgatgggatatcgacatcgtgtatgggtggtccgatggcgacggcagcttctggacggataccgagcagttgaagtacgcgatcaagaaagctgggctgctgccatcgcaggccaagtacaagttaatgctcgatacaaagccagggcggcctgatgtggaggggtggagcaaaggaagttatcgctcgacggatggaatggtcaagcagagcctaggctcgactgtcgaacacagcggcctggcgggtcaggccggatattggaggcaacgctgatgctgtcgatcgatgaagcttttcgcaagttcaagtcgcgtctggaactcaacgaacgcgaacagaagaatgcctcgcaacgccagaacgaagtgcgggactacctgcagaccaagttcggcattgcgcgcagcttcctgaccgggtcctatgctcgatacacgaagacgaagccgctcaaggatatcgacatcttcttcgtgctgaaggactcggagaagcattaccacggcaaggccgcatcggtagtgctggatgatttccactctgcattggtggagaaatacggttcggcggccgtgcgcaaacaggcgcgctcgatcaacgtggatttcggtgttcacatcgacgcggaggacaacacggactaccgggtggtcagcgtggatgcggtgcccgcattcgacaccggcgaccagtatgagatccccgatacggcgtccggaaagtggatcaagacggacccggagatccataaggacaaggcgaccgcagcgcaccaagcctatggcaatgagtggaaaggtctcgtgcgcatggtgaagtactggaacaacaatcccaagcacggcgatcagaagccggtgaagccctcgttcctgatcgaggtaatggcccttgagtgtctttacggcggctggggaggatcgttcgatcgcgagatccagtcgttctttgccacgcttgccgatcgtgttcatgacgagtggccggatcccgccggacttggcccggcgatcagcaacgatatggatgccgcgcgcaagcagcgcgcgcagcagctgctgttccaggcgagccaggacgcaagcatcgccatcgaccacgcgcgtcgtggtcgcaatatcgaagcgcttcgcgcctggcgcgcactgtttggccccaagttcccactgtcctgattccatcggcttccatacacgtcccatcgaggtacagcatgtcccagtggtcgctttcccagctcctgtcgtccctgcatgaagacatccagcagcgcttgtccgtagtacgcaagaccttcggtcacccgggtacgaagggggatgcgagcgagaacgtctggatcgacatgctggatacctatctgcccaaacggtaccaggcggcgaaggcgcatgtggtggacagcctggggaacttcagccagcagatcgatgtggtggtgtttgatcggcaatattcgccttttatcttcacctacgagaacgagacgatcattccagccgaaagcgtgtacgccgtgttcgaggccaagcagacggctgacgcggggcttgtggcctatgcccaggagaaggtcgccagtgtgcgcaggctgcaccgcacgagcctgccgatcccgcacgctggcgggacctacccagcgaagccgttgattccgattctgggtggcttgctcaccttcgagagcgaatggagtcctgcattgggcccatccatggacaaggcgctgaacgcaaacctcaccgaggggcgtctggacatcggatgcgttgccgcccacgggcactttttctatgaccaagccagcggcgcgtacagctacaccaacgaaaacaagccggcgaccgcgtttcttttcaagctgatcgcgcagcttcagttcagtggaacggtccccatgatcgatgtggaggcttacggtcagtggttgaccaagtgaggggtcgctgtggcaagcatacgttcggagtaccaccggttcctggcgcacttgacgcagcggcacgtgcacgacgacgtgcgccggctggcgcacctggtgctcgatcacctgcagccactggccgaggtcggtgctgcacgccgggggcgctccacgcgcttggcgccgctggccatcgcgcatctggcgcagatgcctgtcgcctacgacggggacgcgcgcggccccgaaaacgggccggcgctcgggcgactgcaccagctcgaagtcgggccgtttcgaggattcatgcggcaggagacgttcgacctcagccatgacatcaccttggtctacggtgccaacggcaccggcaagagcagcttctgcgaagccttggaagtggcgatgctcggttcgatcagcgaagcgcaggccaagcgggtcgaccagcggacgtactgcaacaacgctcgcctgcgccgccacatcgcgccagtcctgtcgtctacggcggcgggcgaggcgcaggccgtccagcccgacgaagctgagtatcgcttctgcttcatcgagaagaaccgcctcgacgatttcgcccgaatcgccgcgcggaccccgagcgatcagcgccagctcatcgccaccctgttcggcgtggaccagttcagcgagttcgtgcgcggcttcaacccctcgctcgatcaggacctgatgcttgccggcgtgcaggcggcgcagctggcgcagcgtcgcctgcagttggcgaactccgaacagaccatcgccgcctacccgcagaagatcgcagcggtcgagggcctggaacaagctttggcgcagcgcatgtcacctggcgcgacctatcaaacctgcgtggactggctgctgggtacgccgcagcagcaaggacggctaccgtatgtccaggctcagctggacgccaacccgcctgccattcacgaggtgacccaggcccgcctgcaagcgttgctggcagaggcctaccgcgtccagggactgtggcaagcctcttccgcgcaactcgcggcccgcgccggcgaggtgtcgtacgcgaagctctacgaggccgtgcaagcgttggcggacggggcgaccgcgtgtccggcatgtggaaccgaactggccgccgtggcgcaggacccgttcgccagggcgcgaatgggcctggagcagctcgcgcaactggccgtcctgcagcagcaggaggccgggcatcggacacagttgagcgaggcggtccgagcgctgtgtgacgaaatgcgccgcgtggtggcggcggctggggtcgcttgtcctgccgaatcgcaggccgcgggcctgccactgctgcctcccacgtcggcgggcaattggctcggcggcggggtgaatggggaccagcgcgcctggcaagccctcttacggatcgcacagatcatcgaaggcttcgacgcgcaggcgcgcgacgtgaatgcccagcgcggcgcgatggcccaggagcgggaccgcctgcaacagcatcagctggagatcgaacggctgcggaccatgcgcacgactgcggatcaggagctggcggccgcccgccaaaccgtggcccaattcgacgacgcgaaccgcggcctgatccaggcggccacggacgaaatgccggtggtggtgcaccatcagcgggtcaaggccgcctacgacggtttcctgcccgagattcaggcatacctgaccgctctgccgggggttctgctacaggggctgggagaccaagcccgccatctctacaacgcattcaaccgggccgatccgcccggcgatctgctgcacgcgctgtggttgcccgtggccgagaacggcaagatcgaggtggagttcgccggcgagccgggcgcgcgctacgacgcgttgatcgtcttcagcgaagggcacatcaaatgcctgggcctggcgattctgcttgccaagaacctcgcgcagggctgccccgtggtcatattcgatgacgtcgtcaacgcgatcgacgacgaccatcgcgatggcatctggcgtaccttcttcgaggacggtttgctccacggcaagcaggttatcctcacctcgcacgcagaggagttcctgcaccgcatccagcaggagttgggcgtgcgccgcgccgcggccattaagcgctacaagtttctcccgcatcagggagagcacgaactgcgggtcgacagcgacccgccagcgaagaactatgttcttctggcccagcaggcgttggcggctgacgagaaacgcgaggcactgcgtcaggcccggccggcgctggagagtctgacggaccgcctgtggacgtggctgggtcggcgggcggacggccggatcgacatcaagctgagcgggccccgcgcgccttgggagctgaacaataaatgcaccaagttgcggtcggccgtcgagcgtatcgcggcgcaacatgcgggtgcgccggatgccgtaggggcgttggtccggctgctcaatgtcagcggtacgagtattgaatggggttacctcaatagcggtgtgcacgacgctcagcgcgatcatgagtttgatcgggcgacggtaagaacggtcgtcgaggcggttacggcgttggatgctgctcttgataccctgcagaaccgatgaacggcacacggctttgcagagccgtgccgcccgtgtcacctcataagtacttcttgaagctgcctgcggtcaggctgactgccatccccagcaacgccgcgctgggcagcaggatgaccagaggatgcaccgatatgggcagagcgagataggtggcccaaggcagcacggccaacggcatcaggctggccttcgcgcggtggtagatgaagccggattcgcggcccgcgccgaaccggcgcacatcccgtcgcaccaggccgtcaatcaggccgacgaatgccgccgtgaggatcagcggcagcgtgagcaccaggaccagcaggcgcaccaggaaggtgagcgtcgtgaaggccgcagcgatcaggtagctttcggcccagacatagacttggctgatgtagtagcggaagttgcggctctgcccgtggctgggcgcgcggacgcgctcggcggtctggctcatgcgctccagcaaccccgagcgcacgaacacccactcgtacccggtatccaccaactcgtgcgccgtgcgcccgggctcctgtaccaccacgctgcgcgtgaagtggttggacaggtgcccgagttcgtaccgcagcatctgctgggagtggcgccagccctggtccttccagaacaggtgcatgccggcgcactccaccacgatcgagaacagcagcgagccaatgagcaccccgagcagccggaacggtaaggtgatggtgccgacgatcaagccttggcgatggttctgctcccgctgcgcggtcgaggcggcatccttcatggcacggcctcgttgcccgcgccatcgtcggcgccggtggccaccgcgccgggctcggccgcagcggcatcgtccagcaggtcgtcgggcaaggccgcatcctgcaaggccgacgagctggtgaactcccaccactgcgtggcctcgctgtagctctggcgcatgtacccggccagttgctgcaggtccgccggcatcacttcatccgggtccggcgccggcagcggcatacgcaccttccagagctggccgccctgcagcagcgcgaagcactggcccttgggcaggccgacgacgtgtgacggctcgatcatcggcacgctggccatgctgatgcggtcctgggtgttcgacgtgaaatccgtcgcgccgcggatgtctgagctgtccgtcgcgcccgagacgatggtggttgtatagacctcgaccttcggcaactgcctcgtcagcagttccgcggtggccgtctcgcgcacgcgcaacatgaataaattgttgaaattcccgatcacttggccggccttcgcgcgatttccgatgcgggcctcgatgtccgagagcgtctgcgtgtacgccgtgacttgcaggccggcaccgccgcccttgttgatgagcgggatgaattcatcgcccatcagttcattgaattcgtccgcgtgcacgttgatcggcacgcgagcgccagccactgcgccgggcaggccatcgtcgattccgtgcttgtagatgtgtccggccaccgaaaccaggtcagagaacatcgaattgccgaccgctgcggcgacctcggcgtcagacaacgcatccagacccacatagacgatggcccgctttcggatgacctgcatccagtcgaagatcgggcgcgggtcggccaggtcggagtagttcggcgccaggagctgggcgatcttgccgctcgtgagcttttccagcagcggcagcagcgatgcaacgatcttgtcgaagtaggtcttgtcgtagcgcaccgccgagcgcaggccatcgagcacagggtcgtagttgcgcgcctgggagaggtattgctccagcgccaccacacgcttctcgcgcccgatcatgttccttgggatgttcttctcgttgagcttggcctcgatctggacgatcacctcccaggccttgggctccgtcttggcaaagtagtgctgggcgtactcaatgaacagcgcgtcgatgttgatgacgtggcgctggatcagcatgtagtccgggcgctgccccagttccaccagggcgcgggcgatgatgttcacgaagcgccatgcgaactcgcggaacgccgcgctgttgccttcgccggagagctgccccgcgatgcgtgtcgccacttccgagatccgaccgaagcggcccacggcgttgtagcgggcgctgatttccggccagcccaagtggaagatgtagaactcgccttcgcggccagcgcgctgggcttcgacgtacatccgtttcaagagatcggcatcccccttggggtcgatgacgatgacgacctcatgctcgccggcagcattcctgcggcggatgtcctgcgtgacgaacaactcggccaggcgcgtcttgcccacccgcgtggtgcccagcaccagcgagtgcccgacgcgctcgcccagcggcaggctgacgtccacttcgtcgggctcgatgccgtgcagccttggcaggccgccgacaggcggcaacgggcgcacggggttgaaaggcgcgtcccagccggtgagcttcggcaggcgcgagagcggcaatggcgcgaattccagccgttcctccaggcgcctggtcagccggtaggccggcgtcggctcgacgtagcggcggaactcgggccggtacgtctgcatcagccgatgcgtgtgcttctgctcccagagaaagccgcgccccacgaataggcgctgctggctgaccggcacgtccttgctggtcatcacgtaacgcggcagacggcggatgttgcgccggtagcgcaggatgatgcgggcatcgcggtagcggatcgcgccgtaggcgccgaacgccaaggcgctgccgatgcccatggccgggctcagcgcgagcgaccatggggccaccaggcacagaaacgcggcgcctgcacacgccgcgacggtgtatagctccaccgctgggcgtagcagaacctcgaccggctgtttgcccgacatggcttcattgctcgatgccggtggccgtgatcagcgccgggtagtgccgcaggcccaggcgatcggccaggtcgtcgccggccacgggcgcgagcggcacgcccggcaccagggcgcgcagccgcgccaggccctgcgcggtctcgacgttgacgaccaggccgaccgcgccacgttcgcgcaaagcggcggcgcggcgctgcaaccaggcccgggaagcctcgtcgtcgccgatgaccacgaacggccgcaggccgggcgcttcgatcacccgtcgcgcgacggtgccgggcgtgagcttggcgctgcgcaccggcagcatcgcggcttcgtccgcccgtgtggcaggaacctggggcgtcgggatggacggccgcgccggtgcgttggcgcgcggctggagattcagggcttcgtagtacggcaatgccgacgtgccgccacggtcctcgacaacgatcagtggctcgccggcacgcgaggccagcggcaggcctgacagcagcatgagtaggcccgtgaacgcgagatgggcgggatggggtttcgtcatggggaggtctcctggcgcgccgcgaggaccgcggcggctggtcgcgtgccctgcacgcgggcaaggtggcgcgacacgctgcgccgatagcgggcggcgggctcgccgcctgcggggcggtggtagcggccgatcgccagcagccagtcctcgccgggggtgtgctgctccttcaggatctcggcggcaacggccaggttgcgatacggatccagcaggtcgcacgcgccggtaaagcggtgcttgtggtagccgaggttgatctggcccaggcccgcatcaatgcgcgtgtgcggcgtggcgcgcatcgcctgctgcaggccagcgcaggcgtcggcgcgcgtggcgaagcggcgcgactggccggcgacgttgagggaccacggccacggcaccaggcgcccgttgcgccggatgccgctctcctgcaaggccacggcgtagagcacggtcgaggggatgcctgcgcgctgggcggcaagctggtaagccggtggcggaacctcctgggccagggcggcaacggcatacaggccggcagtgagcaccagtgcgcgcaggggcatggctacggctggcgctgccattggccgttcacttcgcgcacggcggcgggcagatcgccgggcaggcccagtgacagccagcggccgccgtcgtggttgagcgtgatgctgccggcgcgcacgcgcgccgggtcgatctgcgcgcgcttggcccagtcgcggatgcgcgcgtcatcctggcggctgcccaccatgtacaggtcgaactccgcgcccgaggattgcaggcgctgcacgagctgtccgcaggctgcgcagccgtccttgacgaacaccgccatgcggccgctgccgcgcaagggactgctggatgggccggcgcccggcttgtcgtcgggcaggttcacgcgctgcatccccggattcaggcgctgccaggcctcgtcgtaggcgcgctggtaggcgagcagcttctcgacgcggcgcgcttccacctgcacctgcagttccgcatagcggcgccgttcttcgtccgtgcgagcttcgatgcccagggcggacagcgggtccaggttgggcgagtagatacccagcggcccatccatcagctcgcggtagcgtgcccattcttgtggctgcaagccccattcggttgccacccggtcgtccagcacgcgggcggccagcgggcgctcctggctctgtgcgttgcgcgccgaggtcgttgcgggctgctgcgcccaggcgggccattgcgacgacgccaccaggaccgcgaaaaggaggatcgacggcttcatggggtgctccggtcagggaatcgccacgcggcgggtctggttgccggcctggaacactgcggtgttgccctcgatcgcctgcaggcgccacgggccgaccgcatccccgggcagcagcacctgaagttgggcgggcgtgaagtccccgatgctcggcgcgacggacacgctgcgctggccggcgcgcagttcggcgccgacgacgcggaatggcagcggcggcagctcggtcttggaggcggcggacgtgcgcgatgcgcgccgctgggcgggtgcggtggcacgcgcggcggcttggcgcgccttgatctgctcgacctccgcgcgcagcgcctggaggtcgtcggccgctgcgtagccactgagagatttctcgacctgggccgcgcgtgcttccagaatctggcgggtgtctttgaggtcagcgtccgtcgcgacggccgggcgctgctggatggcctcgatcgtctcggccaagccagttgcctgcgcttccaggcgttgcaggcgggaatccagccgctcctggtcggcctggtcgctgagggcctggtagcccagggccgccaagacgctgaggaagatcaaccagagccacatcaggctctgcaccaccacggcggcggtcgatcgctgggcaggttgcggggcgttcatggctggcctcccgaaaccatgggtgccagcgggaacgtctgcaccgcctcggtggcgggtggctcggatggggactcggcgaccgcgcgatcgccgggccgctcgaagcagatttgccgtgcgcggtcatccgcgtgcagttcccaggccgggccagccagcgtgagcagcgcatcgcgcaaggtcatggggccgaggtgcaggtgtaccgccggcaacggcagcgcgtacagctcgatcacggcatgcgcggtctggcacaggccatagccgctgcgtttgagcacgtgccgaagcccatccccgaccgtggcgcgggcatcctcgggcatggacacgtcgatggtctgcaacaacaggtcgcgctgcgccgccatgggtgccagttcgaccagtgtgtagcgggcgtagcgcacgaccgggatgtactcggaagcctcgggttcaggcgcggccaagacttccgcgatggtgtcgggcgcgaccggcgcagtcgtcgtcgcgcagccaccggccagcaccgaccacagcaggccgagaaatcccgccagaaggcggcgttcgggatagtgaaaccacggtggagaggggcacatagctcggcgtcctgaaacatccagccctcaccatcgccgctcaggccgcgagcggcagcaaacaatgcgaaccaggcagcgtccgatttaccgggagcggcaaaaaaaacggccccgaagggccgtaagtggaacgtgtcatgcggcgacaagctgccgggccagtgcgacctcgacggaatcaccgtcctggttcaggacatcgagcccggattcgggcacgtcgcccgaggtggactgcgagaccatgatcttcttggccatcagctccaggcaggtcatctgcgaggaaccggcgtagccgaggtagatcacacgcacgggctgcttctgcccgatgcgccaggagcggcgtgccgcctgctggagcgagtacacgttgtagcccgactgcatgaacacgatcgtcgggaactccaacaggtccagccccgtcttgaccaactcggggttggtgatgagcacgtcgatgccacggtccagttgctcggcgatccagtcttcgcggcggctggcatccacgctcgcgcgcagcaccgccaccttgaagccttcctgctccagcaacaccttcaggcgcgacgtggtgtcgcgcgtgccggtatagaccgtgtaggccaggaccttgcggccctgcgccttctcctctttgcagatgtcgatcagctcacgctccttggggctgatctcgaactcgttgaactgagccgggacaaacgccaaggtgttgcgcgtgcgcggatgcaccacggtctccgaccggaagcagcaatccggccaggccagcagcacgttgaggaccacacccagcaaggtcgtatcgcgtcgcgccagagcctgtttcagctcggcggtcagccgacccgccagatcgcggtaggccgcggcttgcgccgtgtccatcgcgacttcacggaactcctcgtcatacggcggcaggacgttgccgccgatgtccttgagcttgaggaagatcgtgaatggcaggatgcagcgcaagacgcccttggggccgaagcccggggccttgaccgtgcgcaccgataccttggtgcccttggccgtcttgtgcgccgtgccggtgctctcggagtagatgtccttcaacaccccgtgatcgcgcatgaacgccatcgcagccgaggtcatgctgccgctcgtggtcgggcggtagccgtcttcgatcatccgccccggaagggctcggaacagcaggtgaaaaagatcatcaccgtagccgcccatcagcgtgccagtcagcagcaaggtcttgcgagccttcgccgccagcacgcccatggcctggccctgggcactgcccccgttcttgtactcatgcgcttcatcagcgatgagcaggtcgaacgtaccttgcggcaagtacctcttgatgaactccgagggttgataaccgccctcgccaaagccgaactccatgttggccatcgcacgttccatgcgcgtggcttgacggtcggaaaacaccagctcgccgttgccatccatgaggttgatgaactcgtggatgttgtcgcccagcatcgaggccaggaagccgtcaccgaacttctgcatcagcttctgcgcagtgacttccccgatggtcgggatgcgcttcagggctttgaggacggccgaggactggtcgctgccggacaggctgcgcgggcggatcagcgtccacaggggcgcagcgcaatggctgcacttcctgcggtactcctcggcttcgagcgcgaccgggttgaccggctcgccgtcgaggtcggtgatgaccgtgccgcagtccgggcaggccgccacgtcgccgtggcgggtgcgccgctgggtgaagacgggcttccagtggaaacccatccgcatcctgacgcgccccaggacgaagaactcctggcccgtgggctgcacgcccaactgctcacgcagcttgaggagcttgacgagcgtatccggcccattgagcacccataccttggcgccggccaccgtctcctggatctcccgccgccacttgtaaaccaagtgcggtggcgacaggaccagagtgcggcggtagccttcggcgttgagcacggcggccgcggcgatgccaacggtcgtcttaccacagcccatctcgccattgacgatcgcggcgcgttcgccacggtcgatcagcagctcggcggcggcgtggacgacttcggcctgggccgggaacagcttgcgtttgaggctggcgacgatgagctgccggtgcgcctgcggttggccggtatagacaggcgggttggcgctgttgagggcgtcgagcagttcgtcgccgaactcgccgacgaaatcctgaaggctcagggtcagaggggatgattccgcgtcgagcagttcgccctgtacgggcgcggcgtcagcggcagtggtttcgagatcgaaggacattgtgatgctccaatgaaaaatggggcatgcaccacccccagcggggcaatggcatgccccgtggtgggaaggaaatcggcgcgcggccgaaggtggttgaagatgctggcctgagtggcctgcgggtgaaccgtgctcagtcttcggacggcagcacgatggcagtgacgctgcgccccgcatcggtgatgatgcgaatggcgagtcccgggtggatcacatagtgcgattccagcgacgcgcccgattgaagtgcaacgccgttggcgtgccattggcagacgttgacgtcaccccagtcgccacgggtgtggcgcctgaagtacggaatcgggtccaggcgacccgcgcggacaaggcgatcaatgcctcggctgaagatgagcgccccgatggggaacgccagcctctggcagtaggtttcgatgcgatgcgatgccatgggctcctccttgaaaggctattgagccacgacacccctggcggagtgaagtggctccgtcaagtggatgggatgacgaggcggcgccttcagatcaggtcgcgctcttcgggaagctggaccaccgtggtctggtggtcttcgctggtcttcacgagcaacaccagttccggcgtgatccggtactgggagatcatcaggttgtcctgttggattgcgacgtcgttggcttggcgggtggcctcatcgatctcgccccagtccccgcgcacatggcgctggacataggccaaggggtcgatcaggcctcgccgagccagccaatgcaccttctcgctcaacttcaacgtactcggtgcgaacaagggttgcttgcgcggcgcaggccgcttgaacggattggggaacatggtgtttctccttcgatgtggtacagcaggacggcagcgcgtccggtggatcagcgaatggtcagcacctcgccccttgtcggggagccaggcgtcatgtcccacgcgcggataacgggcacaaacttgtcggtgaggatgcgtgtctcggcgatggagccgtcttcgcgttcggtgaattcccgctggagcgtcttgtccttgtgggtgtcacctttgacgacgagcacgcgccccgtctgggagcgcacgacgccggagatcgcgcccgcggccagagccagggcgagatgccagtgggacaaggcccgcgccggtggacgcagcgactgctgcgcggtccccaagtgcgtgtccagcgacggccaaaggccttgcagccggccaacctcgtcggcgaactgttcgggctccatcgtcacgcggaagaaatgctccggctcggccggactggcggggacgatgtacggcaggaacggccattcgctcggcagttcctcggcttcgacttcgccaagcccaacctgcagcagcagattgcgcacggccttgacgccatcgggtgccagctcccgctgacggacccggcggccgaagatcaccacctgcttgaactgcgtttccaccgctcggtagatacgcagatcggtgtagtggcgcgtcaaccagccgaccagctccgcgtcgagcacgtagccggggacgatgaagaccagcacgccgccgtattgcaacagcgacagcgaacgctgatagaacagcttttcgaggcgggcacggccctggccctgatagccgatgttgccgttgacgtccttggacaggtcgccatacggtggattcagccacagtagtccgaaggactgcttggagatcatcgtgtccatcaggtccgcgtgcaggcagtgatcgaccaggccgcgggcatggcgcgcccgctcggcgtcgaattcgacggcgaacgccttggtctgttcgcgcccgagggcatgagaggcttcggcgattgccacgccttcaccggcgcagggatcgaggatgcacatcggcccgtcgctgggcatcagtgcgttgagggctctttcgagcgtgggttcgtcggtcgggtagtacccatttttggcgaaattgcgggcgagccgcgggaacatgagagccatggaagtctcctggttggcggggatgaatgacggaagcacgccaaggcgtgcctccgagggtgggtcaagccgctaccgcttccggcgtccaaatcttggccggatagggataggcggtgagcgcgtcactgcggatcagggagcccagcgccaagctcagcgccggcacgtcgatggcgagccgatggccttccagcggcccgagggcgaacggaaggcgggccagcatctcgcggctttgcagcagttccagcacggtctcgcgccagtggtcgagcagcggcaacgggcaggtgtcccgcaccagcatccacaggcggtcaagccggtgggcgctgtcacgtggcagcagtgccaatgcgctggcgttggccttgtcgggcttgacgcagcgccggtcgaacagccacacgttggacagcgaaccgaacagcgttcgccggtaggcgcgcgtgatgcgcttttccaggcgatcgacgttgccgatgaataccgggacgctgccgccctggtcggtgatgacgtggaactggtccagtccctgctcgtcgcgcccgagggtcaggcgtgcaaggaactgctggacggcggtgtcccgcgcccagatggacaggaagatcaggttgccctggtcatcgccgacgcaggcgtcggccatcacgtccgggcattcgtcgatgcggtacagcgtggaagaagtgtttgcgggcatggtggtgtcctcggatgaacgggaacagcaccgcccgctggggcaagtactgccccagggggtggaagaaaaccgctcagtccggctcgaactgttgggtgtgcggattgaagtgaagcgcctcgtccaccgcggtgatcggcgtgaagccgtccaggtagatgttgttgaggtactggtcgcggtaggtcagcgcctgccgtgcctgctcctcggtgaggccgttgtcgatgaagtaccccagcatttcctcgtcggaggaaacttcgtcgttggacaaactgccgtcaacgagcttcaacagcgagagcgggagtgcagccaggatcgggtccatgtcggttcctcctggctcaggccaacagcgccgcggcgggtgccgtgacagccgtgggtgtgcgccgccgtgcgtggtaggcgcgaacgcctgcacgccagtcggcggactgctccggtgcgaggtccagataggacagcgggcacgagtaatagtacggatgcatggactcttccagcggcttgtagccccactggttgccgcttcgttccagcagatcgcagcggatgtagcgcagggactggcccggcgcgagatcacgatgcacaccttcgaccttggcggtcagttcgaccacggaccacagcacgttgctgcgcaatgcgtgagcgataaccttcgcgctgacgcgctcggtctgctgtggtgcgatcagttccgcgatcagttcagaccgcgattggggagagaaataccagcccatgagaggcctcctcgaaaagttgagctggaggcctccccgtggggaagaacccccagtgggtgatggaatgccgcaggtgcagcgaaggaaaacctatgccttgcccttagtcccagtcgtcatcgtcgcgatcacaaccagccgggcagctgccgaactcgatcccatgcgagcaatagccgtgctccgcattccagtcctgggtttcctgccgttcggccggtgttgcgtagtctcattcctgtgcgatcttcagcgcctgtgcgcgctgttcttcgggcaatcgaccgagttgcgcgtcgatcgccgaactgaagcgttcgacgtagtagtcgtgagacagtccgcaacccttggtggcttgtgcggctgccgtctcgcagagagcccgccacgcgggttcatccagcgcggagcggggtatatcgcaagcgatggtggacatgatgaagacctccagaagatggccagggcctcccccgcatggggaaggaaccccggcgggtggatgaagaacaccgcgcatgcggcgtctgcgatcacgcaggttgcagttcggcctggcggctccactcctgcgtcttgaagtccagcgcgtagcccagctcgcccaggcggacgatctgtgcacgcaaagcgcggcggtcgatggtcgaatccagtttcacggactcgcccagcggccacagcaggccgaagagcgcggggtcaccgtcttgggtgctgccgggggcagcagcctcagcaggtggcggcgcatccacgccaaagggcgtggtatcgaccatcgggtccgcggacgcctgcacgggtgcgggcttggcgggcctggacgctttggtgggcttggccggcgttgccgcaggctgcgccccttgctcttcatcgagcggatcgacgtcctgggtggcgaagctgcgggcttcgtcgcggctgagtttgtcgatgccgttgagcgtcatgccgtcgaggctggcacggatctcgaaccgcatgccgccgccgaccggataggacttcgggaagatgtacctgatgatgaattccccgtcgtacttgccttcggggtactgctccagctccgggtctttgacctcgaacgtaccgaggtgcgtggcgaggcggccaaccgtgaacgggccgttcttgccgcggatggtacgcagcgtgagctggccggggacgacgatgggcgcaaccgatttctcgggtgccaatggggttgccatgatggttctcctgatgatgaatgacgggccgccgacggcacccggtggatgagaggaaatggcttcgcccgaggtgggcgaggtccgcgtggcatcacgccttgagctggcgcatgccttcggccagcagccacaacgcccggttcaggcgcaggttctggtcgatgccttgcaccggacgggtgcgctgattgcggccgttggccgtgcgtccgttcaggccccctttgacgaggttctcctggacgcggttgaagacggcccacaggtcgttcttgcggtcgtcccatcgccggggtgccagcagttggcactccgtgacaggcgtggacttggctggatcgtcgtacttgagtgcgagcgcggagtttgcaaagacctccgcttcgccctcatcgagggtgatggtgcgcatcgcatcgcgcgcgttctgcacgcgctcgaagccgtcgaggactccgtaggcaccttcgatcacctggctgaccacgtcgcccttgtggggaacgcggatgtcggcggtggtgtcaccgcaaaccaggccgttgtggcagacgaaccggaacatgccggcgagcatctgatagctgctcgtgccgtcatggctgttgagcaggatgatctcgttcgcctcgtcgccgttgatctggcttgcatggcgaagtcggatgaggtgcttcgtgtactcgcgccggtcttcgttgcgcacgcgcgtctgacacaccatgaagggctcgaagccctcctggcgcagcttggtcagcacggtcgaggtcggtatgtaggcataccgatcggaccggctcccatgtggagcgtcggcgaagatcgacggaacgacggcacgaatgcggtcgtccgagagtgggcgatcagagcgcaggatcggggattgcggagcaaagcgggataccagagacatggctgatctcctttgagaaattcgacaaccgcgtggccgtgagaccacgcggaactcgggggatgaaatgcgcaagcacgcgtcctggggacgcggcgtacgtggggaggaaaagcgacaaggccccgtgagaggccgtgccggatcagaacgaagcagccaatgccggctcctgctcctggacttgcgcctcgggctcgcgctcggcgggctcggtggccgtgtcgatggcatcgtcggcttcggacgcggatgcgtcttcggccggcggcgcctcggcttgcgcctggctcgtcggatagacctgggtgccgtcgatcttgatgagaccgatgtggaccagcgtcgattccaggctggcggccggttccccggcgtgctcacccttggtgcggatgtacggatcgatcttcatgtcgttcagacggaaggcgatcagcaccttgcggtcaccctcgatggcctgaacgcaccggcgaaccaggtgctcggcttccggggtggcgacgatggtgtcgaagtaccgatactccggttcatcgacaggcccggccagtgccgcgacggtgcaagagaggaacgagtcgccagcttttggggtgacgtccttcacacgattgagatagccgatgccgcgggtgatcaactcgtgctgctcgatcgaagccagttcggcccggtcgatcagttcggccttgagcagtcgcgccttgagggacgcggcggcctgacccttctgctcacccttgtcgcggatgtacacatcgccccacaggtcaccgaggcgaaagcgcaccagcgggcgctgcttgggatcgtcaacgccgatgtagcgctgaacgagcttcttggcctcggcacccgagaccttgacgtcgaagtagcggtagctggggtcccgggcggggccgaccagcgcggcgatggtgcatgccaggaaaggctgcgcacggcggccgccccggacgggcacttcacggacacgctggatgtagccgatgcccgaggtgtggaggtcgaaatacgatttctcgttggacgtggtgttcatggtgaatctccattgggatgaagcggagacacaccggcccacgcatgcggggaaggtgcgtgaccccgcggtgggttgataaggcgaaagcatccgccaccagaggctggtggccgctcgcggaaggatgcggtgcgagctggctcggtcacgcagtgggaactgcgccgcaacctcgaagaccgatggttgcctggcatgtcgctgacgacgtcagcaggcatggggccagcatggcggggcctcgcgcgcgcggcagcaatcaatcggcacccgggcgcttccctttgtccgcgccacccggcgcctgtcacaggcacttggcgccgcgcaggtgctcgggggtatcggcgcgcggacggccgggacggctccaggcgccgccaccgcgcgcgccgatcagccgccagccggcggcgcgcaggctggcgccaccttcgtcgggcatggtgtaggtgagcaggcgtatgtagcccagcgcccttgccgcctgccaggccgcgccgtagagcttgctgcaggcgctgggtgtgccgtcggtgcacagccgcgtgacttccagcgtccaggtgccgcgcgaccgggcggccgacaatggccacgccgtggatcaggtcgctgtcgctcagcgtgacggccagggcgaacttcgcgccctggaccgggcggtggtggcgatggtgcgacagaacgaatgcattggccgtgcgcagcgacaccggtaggaggtgcagcctcggcgaggtcgatggcgtgttcatgcggttgtctccggtggcatgccggcgttgtggccggcggggcgtgcctcggcggctggagacaaacgcgcacgcgcggcgatggcggcggtgcgaacaaaagaaggcccccgatgcgggggctgcgaggcggttgccgcgtcaggcgggaggcaccactgctaaggacaggtgcgtggcggtggcggaaagcacgagatcgtccgccgagtgctggaggcgcgtgaacaggccgtccttcgggtcgaaatactccgcgaagtcatcgccgcccagctcgcggccggcgaggtgccaccagtcatcgaacgggtcggtgtccgggttgcatccgacggcgtaggcgagcagtgcctggcgcccatccgggcgacgctccccacgctcggcgaggaagtacacgccctgatccttgaccaggacaatgcggcactgattggggacgtctcagaaaacggaaaaaatcgtacgctaagccggttgcagcggtcgtagcggcctgaacttgcccgcgccgatcttggcgctgctgcgccagaggtaatcgccggtcaggttgatgtgctcccagcccagcggcgacaggtactgcaacagggcgtcatcgacagtctggccgtgaccgcgtaaggcgtttgaggcccgttccagatagaccgtgttccacaacactatggccgccgtcaccaggttgaggccgctggcccggtagcgctgctgctcgaaactgcggtcgcggatttcgcccagccggttgaagaacacggcgcgggctagcgcgttgcgggcttcgcccttgttcagtccggcatgcacgcggcggcgcagctcgacgctttgcagccagtccaggatgaacagcgttcgctcgatgcggcccagctcgcgcagcgccacggccaggccgttctggcgcgggtagctgccgagtttcctgagcatcagcgaggccgtcaccgtgccctgcttgatcgaggtggccagccgcaccttggcgttgatcgccttgccggacgcctggaactgctgctgatgcttgtgcttggcagcgttgaacagcttgcccaggatgcggtcgtgcaggtcgatgatttcgtcggtgacggtggccatgccctcgatggcgagcgcaccagggtcgcgtagcggcgctgtgcctcgaacttggccagatcggcgggcgtcatctggccgccttcgcgggcgatcttgagcaggcggttctggtgcaccgaccgctcgatgccggaaggcaggtcgagcgcctgccaggctttgaggcgctcgatgtgttcgagtatgtggcgcgagttcggcttgacgggcgactggcgcagccaggccagccaggtcgtcttgccgttgtcgtggcgcttgagcagatcgtcgaggcggtgccggtgggtggccgacaggggatcggacaaggccgcgtagatgcggcggttggcgcggctgtaggcgttcatcgaacacctcccttttcctcatccggcgcaacaggacagttgcttcacgtccttgttgaaggtctgcgccgcgagcttcagtccctcgaccatggtcaggtaggggaacaactggtcggccagctcctgcacggtcatccggtggcggatcgccagcgcggccgtctggatcagttcgcccgcttccggcgcgaccgcctgtacgccgatcagccgccctgagccagcttccgccaccagcttgatgaagccgcgcgtgtcgaagttggcgagcgccctcggcacgttgtcgagcgtcagcagccggctgtcggtctcgatgccgtcgtggtgcgcttccgcctcgctgtagcccacggtcgccacctgcggatcggtgaacaccaccgccggcatcgccgtcaggtccagcgccgcgtcgccgccggtcatgttgatcgcggcgcgcgtgccggccgccgccgccacatagacgaactgcggctggtcggtgcagtcgccggcagcaaagatgtgcggtgcgctcgtgcgcatggcgcggtcgatgacgatggctccctgcgcattgacttcgacgcctgccgcttcaaggttcaggctgcgcgtgttcggcgcgcgaccggtggcgaccagcagcttgtcggcgcgcacttccccctgcccggtggtgagcacgaattccccgcccgcataggcaacgtggctcgcctgggtgtggtccagcacctcgatgccctcggcgcggaaggcgtctgttacggcttccccgatggccgggtcttctcggaagaacagcgtgctgcgcgccaggatcgtgacctggctgcccagccgggcgaaggcttgcgccaactcgaccgccaccacggaggaaccaatcacggccagccgctcggggagcgagctgctttccagcgcctcggtggaggtccagtggggtgtgtccgcaaggcccgggattggcggaagcgccgggctcgcgccggtggcaatcaggcagcggtcgaagttcacctcgtgcgtgccgccgtcagcggtcgccacggtcagcgtgcgcgtgtccctgaaccgggcctcgccgcgcagcacggtgatggccggagtgcttgccaggatgccttcgtacttggcatggcgcagctcctcgacgcggccttgttgctgggccagcagccgctcgcgcagtacagcgggcgctgcggccggcaggccagcatcgaacgggctttcgcggcgcaggtggacgatgtgcgcggcgcggatcatgatcttggacggcacgcagccgacattgacgcaggtgccgccgatggtgccgcgctcgatcagcgtgacgcgggcgccttgctccacggccttcaaggcagccgccatcgccgcgccgccgctgcctatcacagccacgtgcagcgcttgttcaccgccaacatgcttcgtttcgccaccgagccagcccagcgccttgtctagcaggccggcaggcttgttcggcgtgtcggtaagccgtgcgcgatagccgagcgtggccactgcggcaaccagcggggccacgctcacgcctgcatccgcctcgatttcggcctgccgctgcggataggacaccgaggccgcgcgcacgccgggcacgttcgtcaaagcctgctggacgtgctcggcgcacgacgtgcaggtcatgccttcgatgtggagggtgatcgcctcggccatgattacgccctcactgcttgacgctggacgggtaacccgcgtttgcggtggccttggtcaaggcgtcggcattggtcttggcctcgtcgaaggtgacgacggcctcccgcttctcgaagctgacttcggccttctcgacgccggcgaccttggacagagccgtcttgaccgtgatcgggcacgcggcgcaggtcatgccgggcaccgacagggtgacggtcttggtggcagcccaggcgggcgcgcttagagcggcggccagggcgatgagggtggtgagggtggtgagggtggtgagggtggtgagtttcttcatggtgatctcctttcagtagaacagcggcaggacgtagggaaacgcgagggcaaccagaaccagggcggccacgatccagaagatcaccttgtaggcagtccgcacttggggcacggcgcaaacgtcgccgggcttgcaggcatgggctggtcggaagatgctgcgccaggcgaagaacagcgcgatgagcgctgcgccgatgaagatcggccgatacggctccagcacggtcaggttgccgatccacgcgctagagaagccgagcgcgaccaggacaagggggccgaggcagcaggccgaggcgaggacggccgcgacgccgccggtcgccagtgcgccgcggccgttcttgggttccgacataaggttctccttccgggacttcgcttgatgctgtaacgttacttccgtagtcaactacggagtcaagcgccatggagaacgctcaagagaatctgaccatcggggccttcgccaaggcagcccgggtcaacgtggagacgatccgcttctatcagctcaagggcttgctaccccagccggagcggccctacggtcgcatccgccgctacgggcaggcggacgtggcgcgggtgaagttcgtgaagtcagcccagcgcctgggattcagcctggatgaagtcggccagctcctgaaactggaggacggcacccattgcagcgaggcggccgaactggctgctcaccggctggccgatgtgcgcgcacgcatggcggacctcacgcggatggaagaggccctgtcgacgctagtgagagagtgcaacgcgcaccatggcaatgtttcctgcccgttgatcgcagctttgcattgctgctaaagggcccacttcggctcttagcgtacgatttttttccgttttctgagacgacccctgattggcgatggcttcggtcagcacggggcgcaggtcagcgcctttgaatcgcagtgacatggatgaaatctcctgtgtggaagaatgagaaaggcctccatccgatgggatgaagggcctgtagtgcacgcggccggaacggctggaacgccgtggcggatgcctcgggtcagccgcaggaccgcccggtttcgctgcggggcgtcatgccgggacggcctggcgcttgcgggccgctttcgcgtcgaggatgctcacgtcgatctggcgccagcgcccgtcgtcgatgagcctctccagcacttcgccgagcatgtcgaaatacacctcgtcgtgccgatcgaccagttcgaccgattcaccgttctgacggtgcagttccaccacgtaggtgtctccgccgcggtcgtagaggatcgtcacccggccctcgaacttcgcggtcgagaccgtgaagctgatcgccggcggggtctcgatgatcttggagggcgtgggatcgacccaggtgaagtcgcgggcaccggcatccaccagcatgtgggtgatgcgccggaagcgatcgggggccggcatctcctccaactgctcgatgagctggcccaactccatgcactgcggcgtgggaatgggcagcttggccggcgccgagccgaggatgtgcctcgtgatggtgtacggcgtgccgtccgaagtctcctcggtgatgacctccggcgtgtccgcgcgcagtccgtcgaagcgacgacgggcatagggttggacatgcaccttggcgccttcggcaggaaccgtggtcaccaggctgggatcgagcaccgcgaactcggaaggcttgagcttgacgacgatggcatcgtcggtcgcggcgaccaccttgccgtcgaagggttgggggtcgatggcgaagcccagcgttgaggacagcggctgatcatcgaacacgcggtacttgaacgaccgcacgttgcggggcacatggcctgcgaccagcgaaggcatcatggatttgatgagggaacgatccatggggaaactccttgaggaaaaacaagggattccccgcccgcaagggagaggtcccttgtgggtggcgtggatggacgcggtaggtccgtaggaagaaacgaccagcacggtttcccgcgcttgcagcctcgaaggtctcgactgcctgggcatgtgccggcaacgccgacgaacatggggcaagcatggccctggggcggtctgcctgcccgcaggaaacggcaccgcaccacaaccgttttcctgtgctgcgggcaagaaaaagcccctcgaaaggggctggaggaatcaggcttggtacacgaagtagtgctcgcgctgacgcggaaagaacacgtgtttccacgtgtcgccgcttgtgttgccaccgtcgaagacgaccatttcgtagtcgtcaatgtcggtgtccaccagatcggcgctgtcgatatggcgcatgtgcagcgtaccgctcatgcgctcgaacaccaggatctggccgatggcgtcgtcctggctcatggcgttgacgcaggctccaagctgattctcgaagtcgggcgtgggcaagatgagatcggggaacatgagattgctcctatggaattgaaccagcccggctcctggtgggaggcgggctggcatatgggggataaaggggaaggcttgcgcgtcgcgtgtctgctaggtctcggccagtggcaagcccagtagcgcgggtgcgtcggcatcgaggatgaggatgcgcacatctgcctggccggccagttcaaggatgttcgccaggtcgtcaggcatgcccttgtcgcggtgctcctgtcgaagctgctcagcactgatgccctcggcatattccaggttcttgtctgtccagggcgtggagatcagcttgacgccaatcgccgggctgtacggaacccgaaaggcgatgaacagaaaagcctccggcgtggcgaggtctgccaggttggcgaggtactggccggtttcctggcagatgtgcgcgctgctgacttcccagcaccggctgtaatagccggtctcgaaactcaaccgctgcaccacgtctcgcgcggcttcggccgaataggtatcaccgacatggaccgggcggccgtcgaggtcgtcgccatggatggcatagaccacggcgcccaccacgccttcgccgttgatgccttcaacagcatcacattcagcaatcagctcgtcgctgatggcgtcagtgccgcttttgatcaacgcgaagtcgctggtgacgatgcaaggcgatgagatcaggtcgttgtcggaaagatgcgcttggctcgtgtggatggatcgccagacatgcgggcttccgtccccgtagcagatgcacagcgttcggacgactctcagattccagtagccgcgtacaaagggattgggattctgggtcatggaatttctccagattgaataatggagccaattcccgccaccgggaattgaaccccggtgggttgaaagtggaaaaagcgtcaggcggcactgatcgagggctttgggccaatcggcgcaggctgacggaagaaaaatcgagggacatggccgcgtggacgcatgtccctcatgggcagtgaacaaaaagacggtggtatgccgcagaccggctcaccaaccgctgtagttcaccaacagatcggcgatgaccttgcggcgttgcagatcgagaccatcgaagtccgacagtccttggaagtggcagcgcttgagcatggcaccgccctcgcgcgcgttgtagaagctgaacatggcggacaggaacatgcgttccccgctgctcaggacgccgagtgcgtcgttggcacgcagcatgtcgggacgcagatcccacttgctctttgcctggttcaggccttcgcgcgtgccgtcgccaaaccattgcgggcctgcgatctcgacgccgcgcttccagacctcgaagaaggcttggggcgcggcggcgaaatgctgctcttcccgcatgatctgatcgacgacttcctggggcaaaagctggttcatgacgtggttcctccagttggatcagggtgtggcgagctgggacccgccgcctctttcgagggcacgttgagccgcggcatagctgcggaagtactggcaggattcccgcgaaacgggaccttctgtatcgcgcgtgccgatgtagtggccggcggcgctatgcaggatttcgagcggcaggaacttgccgcaatggatcaaggccaactggccgaaagaggcttgctgggacgtggacgggctccttggaaaaagcggggcctcgtccctcacgggatggcagctcccgcacgcggttgagaaaaaagcatcggcgtcacgggtgacgcgcgtccgcagactcgatgcgatggcggactggcgggtagcgcggaaagaatccgcggcagcctggaaactctggctgctggcatggtgctgacgaatcagcgacacatgcgggcagcttcatgcgcgaggcgagccgcgtcagccggaaatcggcatttgcaacagccccgattggcgaacgcggaaaaaaagaaagccccgcaataagtgcggggctgtcaggaggatgaggcgaaactgggtcagcgaggcctgtcgcccagtacatgctgcttccacagggcgaatgcctcgtccggtcccagctctgcgaggatgacgatgggctggccccgacgggcacgcagcgatgcgaaatacgctggccggtcggcgatggcgttgagcttgatgccctttaggaacagcaactggcgggggcgaactttggtggtaacgcaggcatgattgcgcttgtttggggcaaaagggccagcgaagcgggcggacacggccagaaaaccgcgacgaactacttgtacttgccaggcgaggcgaacgggtgacatcagcatatcgctatgcggtaaagaagaccgtcctaaagcttgcaggatcccggcatagcttcatcatcacctctccgtgacggctcattggaacgaaaaaggccagcatcgccgtgatggactttcataattgccaggtcaactggcttgcgtgctgtttattcacagcaaggcattgcgacgtcgttgcagcaatcgccgccatcgcaacagggcgttgcagcaaaagcggcggtgggcgctagcatgagggccaagccgcggccgctcatgctgggggccgttctcttcagattggtgtcctgcaccgtgtgcattgcgaatttccggatcgtcccaatgtcactgggactcctttgtggcggccgggttctccacgctcatgaacgactgggccaccagcgcgatcgccccgcccacgatggccatgtcagcgatgttgaaggcgggccagtgccagccgtgcaggtgaaagtcgatgtagtcgataacgtgcccgcgcgtggcgcggtcgaacgcgttgcccaatgcgccgcccagaatgaggctgtacgaaaggccttccgttttgcgcagcggccgggagagcagccatgcgagccatgccgatattgcgaacgcgatcgccagaaaaaaccaccgctgccagccgcccgcgccagcaaggaagctgaacgccgcgccgggattgagagcgtgaactaggttgaagaatgacgccacctcgtgcgaccaacccaagggagttgtcgcgtcaatgtagctcttagctgcctgatcgccggcgaatataacgatcgcgagtgagtaccactgcgtcttgcgaagagatggttcatccattgttcatgccgccttgaacttcaggaggcgcagcccattgacgacaaccaaaagacttgcccccatgtcagcgaacacagccatccacatggtggcatgccctgtgaacgtcaacgcaaggaacaccgccttgatgccaagggccagaacgatgttctgcgtgaggatcgccgcagtgctacgcgacagccggatgaaggcggggatcttgcgcaggtcgtcgtccatcagggcgacgtcggctgtttcgatcgcggtgtcggtgccggccgcgcccatggcgaagccgatgtcggcacgggcgagcgcgggcgaatcgttgatgccgtcgcccaccatgcccacctggccctcgccgccgaccaggctttcgatggtcttgagcttgtcttcgggcagttggtcaccacgggcttcagagattccgacctgggcagcgatggccgcggccgtgtgctggttgtcccccgtcagcatcagcgtgcgcacacccagcgcctgcaggtcggccaccgcctcacggctggtttccttcacggtgtcggccactgcaaaaatgccgagcacggtcgcatcgtccatcagcaggatcgctgtcttgccttggcgctccagggtctccagccgagcctggagcgtcgcttcgctcaggcccagctcctgggcgagcctgtggttgcccatgtgcaacatgcgcccggcgacgcggccgcgcacgccgcggccaggcagcgccgcgaagtcgtcgacctcgtgcagcgcgatgccgtcacggttcgccttgcgggcgatggcctgagacacaggatggtccgagcgtgccgcgaggcttgcggcccaggcggcaacttcctgcgcctcgccgatcagcggcacgaagtcggtctgctcgggcttgccatgtgtgagtgtgccggtcttgtccagggccaacgccttgagcttgcgcccgccctccaggtagacgccacccttgatcaggatgccgcgtcgggcggcagcggccaagccgctgacgatggtgaccggcgtggagatgaccagagcgcaggggcaggcgatcaccagcagtaccagggccttgtagacccagtcaaaccatgcgccgccgaaggcgagcggcggcacgacggcaaccagcacggacaccgcgaacaccgccggcgtgtagacgcgggcgaactggtcgacgaagcgctgcgtgggcgcacggctgccctgcgcggactccacggcatggatgatgcgcgcgagcgtcgagtcgctggcgcctgcggtcaccttgtattcgaaagagccggtctcattgatggttccggcgaagacctggtcaccttcggccttctcgacgggcaggctctcgccggtgatgggcgcctggttgatggccgatcgacccgaggtgatcaggccgtccagtgcgatgcgctcgccaggacgcacgcggaccaccgcgccctttgcgacctccttggccggcagctctgtccatgagccatcggcctgccgcacggtcgcggtctcgggcgccaagtccatcagcccccgaatggcgttgcgggcgcggtccagcgacttcgcctcgatcacttccgccaacgcgaacaggaacatgaccatggcggcctccggccagtggccgatcgccatgccgccggtgaccgcgatggccatcagggcgttcatgttcaggttgaggttcttcagcgcgatccagcccttcttgtaggtgctgaggccgccggtgaagatcgaaaccagtgccagcacgatcacggcccaatgattgccgtcgttgacccagtacacgccttcggcggccaccgccgcaacgcccgaaaccgccatcggccaccaattggtcttgtgcgcggccaccggggcatcgcgcggctcatcagtcctctggacctcggcttccatgcccagcgattcgatggcttcgactgccggcttgatcgcgtcgggtgtgtgccgaaccgtgagcgtgcgctgcatcaggttgaaatccattccctgcacgcccggcatgccttgcagcttgccgcggatcagactttcctcggtcggacagtccatcttcgcgatgcgaagtaccgtggtggctgtctgcatgtcctgccgcgcagcctgcattccaatggaagcaagcgccttctcgatcggcgctgaggtcgccagcgtgtgctggactcccagcacacgctgcatcagattgaagtcgagcgcggtcacacccggcagcttgcccagccggtcgcggatcagcgcttcttccgtcgggcaatccatgttctcgatccggtacgtcacccgctcgccgatcggcggcgcggaaacggcagcggttggttgctgctgcagggccgaggatgggatcacagccgcggcttcgatcggccccgtgtggccgaaggtctgctccttggcgcgcatgccgatcgaggccaggacctgctccatctgcgcgcgtgcctgagcgaggtgtttcaccgacagggtgcgctcagcgaggtcgaagtcgaggtcctgaattccctcgactgccccgaggtgcgagcggatgagtttctcctcgctcgggcagtccatgttctcgatgcggtaggtggtcgacacggcggcgtctcggacagcctgagccttcatgcccaccgaattcagcgcttgctccaaggcatcggccgagacttcgcggtgcgaaatggtcaacaaacgctgcggaagatcgaacaggagccgctcgacaccgggcatgccctccagcgttcgccgcaccagtgcttcctcattgcggcaatccatgttgctcacgtggaaaacggtggtttcagtgctggcctgctcactggcgcacgccgtctgttggccattgccgccggagcaggcgcatgggctggaaggttctttgttcatagatcgctcttcattgacaaggttttccccggatgccatcattagaaaacctctagtagatatagagtcaagttttttataggaagcaaccatgatgcggatcggtgaactgggcaagaaggcagattgcttggtgcagaccgtgcgcttttacgagtcagaaggcttgctgcccgagcctgcacgtagcgagggcaacttcaggctctatgacgaagtccatttgcagcgcttgctgttcatccgccgctgccgggcgaaggacatgacgctggatgagatccgtcaactgctgaacttacgggatcggccagagttgggctgcggcgaggtgaacgcgctggtcgacgctcatatcgcgcaagtgcggaccaagatgaaggaattgcgcgccttggagcgcgagttaatggatctgcgacgctcctgcgatagcgcccgaacctcgcgcgagtgcggcattctcaacagcttggccgagcccgcctgaagctcgagcgtgtcatcggtgctggaagtgatcgggtccagttctgagagccacgtgccgcgctccatcatgcgaaagcgcgcggttctgacgttttgagacggcgtgcgaccgagggcgtggcccacaggagccagcgcgagccggacgacctgcgcgccgcaatctccgccaccttacgggttctccaggccagaccgagcatcgcggcgtggctgcgcaggtgcaggtgcaggccaaggtagcagtgcgccacgacgcggcccgactcatgggcacgccacgcaactcgcgatcgcttcgcaagaagccgcaaggcccgactcgcgcaagaatgcgacgtgggcaagatcgtatagccagcagcgcaagcgtttgccgctgctggccggctccggaagggatagacaagctgcgggccgtagtccattggaaagtccatctttcttgagtgtcactctttggcgcccagcgtgtgcttttgcgaccggaaagcgctgaacaagtggcccccgggcatccagaaatcgccgtagttgacttgggcgtcttcgtgctcacgcttgtgatgccagcgatgggcttcagccaccccgatcaacaatcccaacggcccgacccggtatcccagattggagtgctggaaggccagatgcacgaccaagaagccgagccatgcgccgacggccaaccacagcttggaacgccgctactggctcaacggggagtggaaaggccgcccgccctctagcaaggcggcacaagcgagcgcgacgatcactgtgagtagctccgtcggaaaagacggccggccggtcgcgagctcgccgaagagcacaaccgcagtggcgccacggatcagtggatagcagccataccggatgacagtcgcaatgaagggggcgcattggtgctcatctgttctgtcctaaagctctgactggattggaaaaccttctagctacggtagagtcaagggcgtccgggaagaccctgtggcaagttcgttgcatctgcgccttgactctccagccgctacaggcttcagcatccatcgatttggaaggaacaatgcatggctgaaaaccacagaaatcacgaaaacgacgagttgggccgcctagatgcgagcgatgcgaaggaccgaaagattcttctgactgtgttgctgatcaacctgacgcagtccgccgccggcattgcccttggcatctgggctggctctacggcgctgatgggcgccgggttggacaacctcgccgatgcgtcggtctatgcggttagcctgtatgccgtcggtcgtgcggcaacggtcaaggtgggcgcggcccgcttgtcgggtttcttgctaatcggcctggccgcgctgctgctgttggaagtcctacgccgcttcgctggaggggaagagcctgtcggcccagccatgatggccatggccgcgctgaacgcggctttgaacctagtgtgcctcagactactgcgccgccatcgcggggaagatgtgaacttcaaggcgtcagcgatctttaccagcaacgactccatcgtcaatggtgcgattgtgctgtccggggtgctggtgatggggttcgggtcgaacatcccggatctggtgctgggcgtcatcgtggccgcaatcgcagcgaatggggggcgggaaatcctgcgcgaagcatcggaaacagctcgccgtaaggcgggcacataaggcatgttttcgcccagttcatcccgaggtttacctctgcaaaagaggtagtccagcctttgggctacggcctcggctgcagccgagcgtaccattggcgatggccgcgcgataggcgggcatgccgttctcgacctccgtctgccgtacagcagcggtgcgcaaggttgagggtgcatgtcgtctctcctgttcgtgtggcccaggccaatggccgggccgggacgttgatgggcaggagaatggcgccgaaggcccaacggccttcggctcgggagaaaagaggaaccacccgtgggctgattggcaggcccggtcgtcgctagaaccatctgctcatcaagcaatcacacccggcccatgtcgtggctggggccggcatcgtctggcgcacatccgcgcacaaagggagcccgtttttgcaccggcgggcaccggcaccgattaccgctgaccacgaagggtctcccggtggctcgtgcagcctggcaagccaccgggagacccttcgcagagggcggaagaaacgcagatcaacagaacgcgcgtggtgcggctcgcagagaagctaccttcaggtcccgcggccggggacggctgggcgggacgcgcacacggatcaagaaggcgttgcgcgctgggcgtcccgcagggcatgcggcggagtgcgggacaggggccacgccgccgaaggcgggcacggctcacggggaacgggggcggtcaggagcctttgcggccgctacggcgcgggcgcgaggcgccgcgcttggagctgccggattcgactggcagcgtgcctttgcagtccgggtagcggctgcacgaccagaacgggccgctcttgccgctgcgctggcgcgtgggtgcgccgcactgcgggcatgccggcccttggggaaccttgatggacagggaggcgctgccgtactgcgcaatcaactgcgaaatccacgcggcctgcttgccgatgaacacgtccagggtgagctgtccggcctcgatcatgtcgagcgcctgttcccagacggcggtggtgccagggtcggcaatcgccgcaggcacggcatcgatcaaagtgaaagccgcatccgaggcgcggatggcgcgccccttcttcacgaggtagccgcgagcgatcaggccgccgatgatgttggcccgcgtcgcttcggtgccgatgccaaccgtatccttgagcttctgcttcaggcggggatcggacaccagcttggcgacgcctttcatggacttgaccaactcgccttgcgtgtacggtttgggcggcagcgtcttgagtgccttgagatcgacgtcggccacctggcatgccaggccctcatacagtttcggcagcgcgggcagcacctgggcgcggaccgcagtatcgccctcgccatcaccgtcttcggcctgcggctcggcgagcacctggcgccaacccgggatgacaacctgcttgcccgtggccgccaggttctgccccccgcacgaaaacttggccacagtgcggtcgaactcgtggtgagggaggaactgcgccaggtaatgcgaccggatgagcctgtacacggccagttccttctcgctcatggcggagagcttcgccggttcgagcgtcgggatgatgccgtggtgcgccgtgaccttgccatcgttccaggcgcgcgagcgctgcgagcggtcgagctggcccatgatcgagcgcagcgagggatcggtcttgagcaggctgtcgagaacggtgggcacttcggcaaacatgctctcgggcaggtagccggagtccgagcgggggtacgtcgtggccttgtgcgtctcgtacagggcttgggcaatctccaaggtttcctgcacgtccagcccaagctgcttggaacacacttcctgcaaggtgcccaggtcgaacggcagcggcgggccttcgcggacacgctcagtctccaccgacacgacgtgggcactgcccgcagcgcggatctgctgcatggtctgctgtgcgaccggctgccgcaggcagcggcctgcgtcgtcggtgcacgcatcgggtggaacccattgcgcggcgaaagtcgaaccgcctgcgaacagggacacggcgatggcccagtatggtacggacacgaagcgcgcgatctcgcggtcgcggtccacaacgagcttgagcgtcggggtctgtacgcggccgaccgacagcacgccgtcgtaacccgcctgtcgccccagcaccgtgaacagccggctcaggttcatgcccacgagccaatccgcacgggagcgcgccagcgccgagtggtacatcgaaagcgtctcggccgaaggccgcagctggcccagtgccgcccgaatggacgcatcgttgagcgccgacagccacaggcgttcgatggggccgcggtagccgcaaagctccacgatctcgcgggcgatcaattcgccctcgcggtcggcatcggtggcgataaccaggtgagtcgccttcgccaagagcgccttgacgaccttgaattgcgtggcggtcttcggtttgacctcgacccgccagtgctggggaatgatgggcaactgctcaacggaccatcgtttgagctgctcgtcgtaggcctcgggcggcgccgcctccacgagatggccgatgcaccaggtgaccgtgacgccggaaccgttgaggcagccttcaccgcgctgcgtggcgccgagaatccggccaatgtctttgccctgggagggtttctcgcacaagaacagccgcatatccgtccatcccgattcctgttgttcatggagttgctgggatcgaggatgccgagcgcagcccctggcagcagcaaacaagccgcatgcggcagcgaccgctttcacgccgatgaaatggcgagtgcggggaaggtgcgtggccggaagtgtgcgggccgagagccgcgatttccgggagcgcgcgtggaactcggtggacgttggtggagctatcccctggggataattcgcagcgcatggagggcggcgaagcactgcggcagccgccctccatgcccgatcacttcctgcgcttggtctctttcggcgccgtcgattcctgggtggcctggggcttcggctctgcctcctgtggcttcgggctgagggccacagactcgatgcggtacggcaggatgccgacactgcgcgcgttgacctgccaagtctcacgcggctgatcttcgttgtccgtccaggggtcgcgctccatgcggccgacgaccagcacccgcatgcccttctggtagagctgctgccagcggtcggcgtcgtggtgccagagttccaccggcgcccagaagccgccgcggtcctcgaactcgccgcccttggtggggacggggttgtcgaagtacacgttcagccggagcaaccggcgaggatcgtcgttgccattggggaattcgcggtactcgggaggcgatccgatgttgccctcgccgatgaattgtgtgctcatgttggaatctccgtggtggttgaaatacccgtgcctcgttgggctcgggcgcgtgctcggatggcaggcgcaatcaccgatcgcgcactgcggcaggaacggacgcgagccggcgcaggtaggtgttgtccgcctgcgcggccttgctggcgcattcctgtgcttgcctgcccagggtgtgcagcaggctgatctgcatgttcagcatgacgcgctgcagttcgatctcgtgcaggtcgtgcagcaggttgaccggcgtgctggggctcgccatcagctcctgccacaacgccacgcccatggccgatcgatcgtgcttgcgccagcgaagaaaggtcgtgcctgcgccagtggtctgctgggccagctcgacgggaagcaggtggaagggatgcccgcacgcctgtggcagcacctgtcgctgcgccagggcaatcaactcgtcgcgcatggcgaagcactggctggcccaggcctcgaagtcccctttacctttaaaaggctttaaaaggccttttagagaggccgcgtgttccagccgcatgaaggctggctgttccagacgacggaagtagcgcggttcgcggttcgggtcgctcatgccggttcgtcctcgccggcggctgtggacttggcctcggccgaatcggcggcagcgccttcgtcggtgggagatgcggctgcggcagcgctatcaccacgctgttgcagaccacggcgcacgacgggcggcgcaaacttcgagcggcgcatgccttcgagcacgtcctgcggcagttcgccgaacttctccaatgctgcccgagctgcggcgttcttggccgcgaagtcgtcgcgggtgcagcccgagtagcggtattgctgggccaggctgaacaggctgcgcagcgcgtgggcaccttcgttgagccagcgctccaacgtcgagcgatcgatcagcgcggtgtggtgggcgaggatcagcttgcgcgcgatgtcgtcgtagtcggccaggagatagacggcggcaaagcccaactgcgcattgacgaacagcggaagcttgacgggctgcacgttgaggttctcgcccagggtcaacgcggcgggcacgccggccagggcctggtccacctggtcgcgcagcgtctgcagcgtggtcctggtctggtcgagcttgtcttcgatgcgaagcatccaccagtcgctgtatgggtcgtcctgctccgagccgcgcttcatcttgttcatgacggcgatgtagccgttcaggccgacgatgcccggtcgcccctcggcggcggcgcggccatgccagatgcgcgaggcgtggtgggtgtgcagcgtcagcgacatcgcgctgcgcagggagccgaggttgagttgcaatggttcgttgctggttgccatggtgatcgctcgctggtggacagggagccgccagcatccgcatgcagcggaaggcagtcagtcaacaaaccgaaatgagccgacccccggttctgtgcgcgctggcggcgcagcgcgcaacggtcccctggggaccgctccgcagatgggcactcacatcggcgttcccgtcctcggttgttgacggtatgcgtgctgcaccgcacgtcgcgctgccgttcgacacgatccttcgccgcgcagccgtccccaggggaccgttccgttgagcgccatggaggtctgcttcatggtcttgcatgcgctctactcaggttttgcgcagcatgtcgcgccgtcgcccggcgcttcaccgcacagccgtccccaggggaccgtttctgccgaccgccatggagatctacttcacggctttgacaagccctgtgctcaggatttgcgcagcagatcgcgcaggcgctcgatgtgctgccgggccacctcgggcggcacgacgttgcgcggcggctcggttggtggcgctcgcgccgccgatggtgttggcggtgccgggccggtctgcttggcccaggcattgaactcgccgcgcatggcgcgctggatgatgccgaacagataaccggcggggttgcggatgccatgcttgccgcaccgtgcggcccattcgtccagcacggcctgccgcagggcagcgtccacctgctgcaacgccatcttggctccggcctgctgttccgccttcagttccgcgaagcgcttgggccattgcaggtcgcccagcgcacgcgcctgcgcggtagtacgtacttcatcaatatgactactacgtactgtacggtcctgcttcgaattccgaagagcgccgtctggcgcgggtttcggccctgcttcggattccgaagatgggcgatcgctattccgaagaaggctcgcgggcccttcttcggaatcgtggaccgcatcctcctgtggataactttcggaggcggtgatgccctggtcggccaggcgctcggcgagcacttgcagccgcgacggcaaggtgcgtccggacagcatcgggtcgtccgcgatctcctggagggtgttgagtcccaccacctggacggccttggccgaatgccccagcgactggctgaccagggccaggtagtcggcgtcgagttgcatcgcctcgaacggcgtcagcggttcgtcgtgcaggacgtagaggttgccgaggatgcgaccggtcttggggtcgcgccgtcgtcgcacgaggctcagccagcgcgtcaggcgcagcagcgtcagcgcccgcgccacggtctcatgggaggcctggcctgcgcagggcatcgacgccagccaggggcgcaactgctcataggtgggaaatgccgtgacgccatcgtcgttgagcatcaatcggaacacctgccaggcgttgcgctccagcggtgtcaggcggcggtcgaggaacagccgccgcggcacgctcccgtgccgattgccactgaacaggaaggcgtcgccggacgtaggaggcgtgggcgttggagcaggcagggacgcgggagcgccagagctggacttgggcgcgaggtccttcagcgcagcgtcgaacaggtcggcgagtgcgatggggccagggcgctgggctcgtggggcggtgtcgtccacggccatggcctagcccaatccctgatcgacccagttcctgatcgcggcccagaccaccgagagcggcagcgacatgccctcggccaggtccatggccgcatcgagaatcgaggtctcgtcctccagatcgacgttcctgctgctggtcacggctttccattgccgccacagttcggtgtcctgggtctcgtccaggacggggtggcgccccttgcgcttgggcaggccgaggatctcccgccgcagggcgacttcctgatgggtcaggccatagaagcggctgaccatctccgtgctggcccccagccgcagcatgcgatcgaccgtggcgatttccttctccacgtcctgtgcctggttgagcaggcgctgcagcacttcgcggttgaccgtgaccgagcaccacgagacgctggcgttggccagcacgctgatcagcgcggggtgcttgagcgcatccagctcggcctcgccgaagcccatggccttgcagcggcgcagttggccgttgcgaaggtcatacagcgcctgggcaatcacggcctggttgagcggatgcgatgtggacatgcggcctccctcgctcacgtcccgggcgccgtggtgccggcttccaggtccagcagacgccgggcgaggcgcagcagccgaaagagcttgaccaacgccgtgtcgctcaagcgccttgcgccgctgccatggccttggctctggccgtgcaacagggtcggcaggtcggcggcgagctgcgcgccgtccaggcccgcttcggcgacgggctgacccgtcagggaagtgagcagcgtcagcaccgcgcggccgagcggcgacggggcttggccgcgggcgcggcacgcaaacccgatgccatcggcgcgatcctcgatgcactcgtccaggcctgcctccccggcgatctcgcgcgcgaactgcgcgatgtggatgcgcagccgatcgggcgtgtccaggccggcgtcgatgtaccagacgtcggagatcggatagagtccgccgagttgcaccgggatggactgcagcacgctcgccgagaagtcgggcggcagcgcatcgcccaactggtcggcgaccatgcgctggatcgattggagccgttctgtcgtcggtgctggcgagacgatgtgctcgcgaagcagatcgcccggtgcggccggctggcttcccgtggccgcttcgccaaccgccgtgtcgtcgtggcgcaaggtgggctcggacgccggagggctggcgggtggaggaccggccgccgctgcaggcgtggcgatggacgatgctgcgcccggcggagtcggcgtgccggcggtgggcgaaggcaacgccggctgcgccgcaggtggcgtcgggtcactgaccagcgcccggtggcggctttccgattcggtcaggtccagcgccagcacgtcgtagccgatgcccagcagctcggacatctggccgatcagctcgtcttgcacgcgctgcggcgcgaactcgtcgccctgcgtgtcgaactgcgccagcacctcctgaaagaaactgtcgaagtccagcggcagcgaacggtccttggcgtagtgctcccaggtgcgtttgcaggccgtgcgcatgaccgacagccgctcgacctggtggcgccccaggccgccatagagcacagtgggaatggcgggcagcaggtagcgcaccgcgtcggccatgcgggtgatgtgcgaccgctggacggggaagccatcggccgccaggcggcgggccagttccgactggctcagggcggcgccgctctcctgctcgtagaactcccgtgctttctcgacgccgagcgcgcgctcgatgaacgtgaggccgccgcgcagttcgttctcggcaagatgcccggtcagcgcgacgatttcaccgcgctccggccatggtcggaacaggcacgatatgcggaagaagcgttcttccttggtctccgaccagagttcgcgcaggatcgccagtcgcgtgttgccgccgttgcggatgatgtagtggtcctcgccgggcctgcgcgtgatggccggcgccgcgtccaggccgcgctcgcggatggatgccttgatttcctcgtaagccgggttgcgcttcatgcgcgggtcatggtcgtagggccgcaactggtccagcgtcacgaccatgggcgtgtccgcgatcgggtcgctcaaggccgtagccgctgggccgctgcgctcgaagccggccgcgagcagcttgcctgccatgtcctgcgaggtcatgtcagccatggccgcacccctcgcagtccccacgaccgccggccggcgccatgcgggcctctcgctcggcgcggcggatctgcgcacgggcgttcaattcggcccggtggtcactcgctgtcgaactcgtgtagatcgccgcgcagccggccttggtgaacttgaggtgcccgcccggcgtgcgcttgacgtgccagccctcaccgaccgcgaactcgatcagggcgcgcagccgcttgtggccgcgggccagctcatgtgcgttcgccatggggcctcccaggatcaagaggtcgctgcgggcggccggatacttgagccagtcggtcctgccattgcgggaacaactcgctggcgagcgcgcgcatcgtgtcgagcgcggcaggggcgactctgccgggcggctggcggtgctcgacccgatgcaccggcaggccgcgcgttgcggcacgtggatacgcttctatggccggcacgtcggtggcgagcacgcggatgccggcgctgtcctggaacaggtcgcgcaaggcctgctggatcagccgtgcgttggcggacaccgggtggacgcggttgatgagcaagtgcagcggcggcggttcgatgcccaggtgccggtacggcgcaatgtcttcgagcaactgcatggtgccgcgccgcagctcgcgtgccgcgaggatctccggcgtgacgggcgacagcgcgagatcggaggcgagcaccgccatctccagcagcacggaacgcgcgccctgggtgtcgatcagcaccaggtcgtagaggggagcaagtgctggcagcagatgccgcaaccgcaggcggccatccggcgcatgcagcaacaacgtgttcagctcgccccggtggtcgtcggacagcaccaggtccaggcccgcgatgatcgtgcgggacacgagctggccaaggtcgcgctcgttgaaggccaacagctcatagatgccgcccggcgcgcgctgggtcagttcgtagtaggaggacaaggtgggctgcacgtcgagatcgagcagcagcacgcgcaggcccgcgtccgcggcgagcccgcccaggttggcggccgtcgtggtcttgccgacgccgcccttcgttgaaatgatggacacgacctgcatggcgctctccggctgggaatgggaagtccgcgggagagcgggtcaggtccggtggttgaggcgctcggcgatccactggtcgatttcgatcgaatcccagccgacagcgcgcacgcccaggcgcagcgcctgagggaactggcgcttcttcatcaggttgtagatgtgggcgcgtttgaagccggacttcgcttcgacttcatcgagccgcaggatgcggcgctcgttcggcgggagtacaggggtctgcgacatggcggtcactcctgaacgctcggtggcgtttgttggcgtgacctctattcaatagacctggctgcggaaagacattgcaaatgcaatctccgcgattgcacatacaagctggataacctcatgcgcttgcgctacgaacgtacctcttagcgttggcgaactttccgtttaaggtgcgctcagtgatgcccatggtgccgccgtagtgggcgaccaatgcagagacaagggcctcctgcgttttgaagctggaatagggcacgcctgaaggcgactggctcagcatcagcgtcaacatccctccaatgatgttgagataggtcgtttccgcccgttcgctgatctcgcattgcttggatgccaacagcaccgaggattgcttgagtagcgtgtcgtgctgctcctgcagttctcgcatctcacgtcgggcttgttcaagcgcggcctgaagggccagccgctccacgaggatcgcctgtcctgtttccatggtgatgaaaggatgcgccatgcgttcgccacggctgaacagaaatcctggccggtgctcgggatagtgggtgcgcatccagcgttttagatcgacatggcgaacagtcagatccagagaattgagcaggttcggatcattgagcgtgatcccgttcttgccgtagggcagctctccgttgaggatgccgtcatagatacgttccgagtgcagccggcactcattccatcgagggcagttcagcgaccgaggcaggacacgcggtgacgcgatcgtggccaggatcatcgggagataccgcagcaacccagcccatcggatggccgcctcgatgggacgatagaacacctttgatgttgaaatgtccttgtgcatgtcttcgtctcctttcgggtgcgctacatcaccggctcctttcttgcccaagggctgttgtgtcgttatggcctgcgacggacgcttgaggcgatgccctaagcgaaggcggaggaggccattggcgtccgccgcaggtggccttgtcttgcttgatatgcaagaatcgatcagttgccggcccatcgagcgatgaggacgcaagctcgatattggcgctcacggtaccagcgtcataggtggcgcaaagcccatcaagaccgatttggtatggtctgatatccagacggttcaagaccagcgagttgaagcgttcgacgcccctacgtccagttggggactggaaatcagcggttagtgatgcatcgctccacatgctgatatatcgacaaagtatctgccgcagtaccagtgaccctgccaggttgccccagcacataggagacggagatggctgaacattcccatgaacatcaacatcacacatccggtcagatgggtaagcacggccgaccatacgccaagttctgggtgaacatggtgttgggcctcgtcgtcatgtacttcgtaatgttcagcatgatcgacggcgccagggacttcagaaacaatctcaacatgctctacatggcggtcactatgtgggcgccaatgggcatcttcatgctagcgacaatgcccggcatgtttccaaaccggcggctcaatctcgtgctgtacggcttgtttgccgttctcacactcggttcttttgccgctacccgtgctcaaaccggaatcggcgatcgacagttcatcgcgtctatggtcccgcaccattcgggagcgatcctcatgtgccgcgaggcgcagctctcagatccggaactcgtcaacctatgccaagcgatttccgatggccagcgcgcggagatcgagcagatgaaccggattgctgcacgccttcgttgaggctggctgccactacactggcgccgcgttgcgctccggcgaagttagccgcagcgatgtaaagatgagtacttgcggtgttccgatgccggcggttgtgtcctacagccgtccaggtgccaggtagtccacgcgacaccaccccgcgctgcctgcggagcgagcgcaagtcatgatcgtcgcaagttggagttcgatagcgaacccgctcagcagctggacgcatcaggcgtaacgacgggtggatggatcatccttggacgctggtggaagtggttggatgaactttgttgccgagggcgaaaaacaaggctataattgagttcttcgctgatcaccacagtggagaaagtgattgggaaacagagacttagcgctctagtgcatgactcagatccggcgccatcctcgtgaccctgatgggggccatcctgatgctgaagggctatcgcgccccccatcgggaccatcgccgcaccgaggtgtggcaggcggtgaaatcggagctgaagctgccggccgaacaggcccgggcgctgatcaacgccacgctccaggacacctatttccaccacgccaccctggtgggcgtcggcgccctggcgctgtggacgacgatcgtggccctggggctggtcatcgccctcagataagggcgatgaccgccagcccctcagaagcgcaggcccaggcccgcggtcacggcggtctgcgcgccgtcgtcatggccgaagcgggtttcgacctcggcataggtagagaccgtttcgccgaagaagatccgcgcgcccagcgtcgcccggccgaaatcgtcatcggcctcggccagcgccacctggcgcgacgacccgtcccccgccgtcagacggatggcatcgggccggccatcggcgaattcatgcacccaacccgcgcgggcatagggcgcaagcgtcgtggtctcgcctatggcgatactgccgcgcacccgccagccaagctcaccctcggcagagttatagctttgatcgggataggtgagcgcggtgcgtgccggtccgctctcggtgaagccgtcgagttcatagcgggtatagtccagcccgaccaccgggccggtggcgatgccacccagcgccagatcccagccgccctcgatccgcgccccgaagctgcgggcattggtctgcgcatcgaagcgctggtccaggatggtggcgcccagtcccgaggtcatggtgaaggcacgggtgccgtcgacccgggcatagccggccgacaccgaggccgcgagccagccgggtgcaccgtcattcaccagcacgcccaggccgaaagcgacgccggtgcggtccagatccgacccgctcgacagatcgtcacgcccgcgcgacagatgcagatcggcgcccagcgtcaccagatcactcagccggtgatcggcccggaagccgatgcggccggccgtttcgtgatcggccgtggccgcgccgtcgaacccgcccggccgcgccagaccctcgacgaagacatcgacgctggtctcccccagcccgggcttgcgggtgaacagcgccagcaccgcacggtcgacggccgcctggaaggcctgatgatcgcgggcgagctgatcggtcatcgcaaggctgaagccggcgcccgactgcgccgaggccgcaagatcggcgttggtcagctccaccagcagccgggtcagcagccgcgaccagtcttccagccggccggggatgtgatcggggccgaaggccgcctccagcacgtcccaattgtcgatcgccgggtcatgccagctggcgccacccggaatgcccggattggtggtctgggtatagccgtccagatcgccgatttcccagtttgtcgcctccagccacaacaccgggatgttcagatcctcgtagttgccggcgtcgctgcagcagccggtatcgaccggataatgcgggttcagcccgggattgctgcgcaggtcgatgcccagctcgtcggcaatggcgtggatccgcgtccagtaggatttcagcgccggatcggccagataattggtgccggcatgggcatacatgaaatcgccggtgatcaggctgtcgatattgatcatgcccttcagccggtcgatctcgcccgccgcctccagctcctgccgatagaaggcagagccttcgagcccggtctcctcggcgccgaaggcgttgaagaccagcccggtttcaaccggcagccccgccagatgggcggcgatctcggtcagcacggcagcaccggagccgttgtcgtccacgccctgcagggcggggccggtatagcccgggcgttgcggcgcgctgtcgaaatgggcgccgaccaggatgaagccctgatcggtattgcccaccgtgccgatcacgttctgggaggcgaggccccggcgggtggtaaagggctggcgggtcagcgtggtgccgccaagggtgaagcgcgacgacatccagtcggccgcgtcctcgaatgcctccgtgccgctgtggcggccggcatgatcaatggtcaaggttctgagcgtgtcataggcgaagtcgccatactccgccgcctgtgccggcagggcctggatggcgacggatgcgaacagcgcaagacaaagcggacgcagggcgcgtgaatgcagggcaagcggatgcagggtgaggcggccgggcatctgacctcctgaagggggagcatcgccccggatatcccagggggcgacggtggtgcggggatgagggtgccgcaaggatgacaggccggtatcggcgcaagcttcacacagccttaactgaaccataccctttcatcatccacccggtcacttccggatctgtccggatcaaccactgtcatctgcccctcaaccgggccgcccgtccggtcccagccccacaacccggccaccggtctcccgaagccgggcccgccacgcgcccgccagatggaccacccggcgcggcctcagccgccagagccgctcggcccccggatggcgggcgatctcgggcccctgccagacgatctcgacatcgccggtgatggtcagcaggtcgccggttgcgaaatccggcaccagcagcccggcggccgggcgcagcaccatgttgcccagcgtgttgaaatagcggttgccggcgtagtccggcaccgtgatcacccccgcctcgtcgaccgccacgaagccggccggcccgccgcgatgcgaggcatcggccccggcggcccggccttccacgcgggtatcggcggcgctggcgacgaagatcgtatcggcctgggcgatcatctcccgcgcccgcggatccggcgccgcctgagacaccaccgccggtgccggatccatcccgccgcggccgggcaccgcctggcggggccggatgtaacgcgggcagttgccgaagcactggtccaccagcaggtcgatgcgcggcgcgccgtcacgatccagcgccagcacccgaccattgacccggatccgccgccgggtggcgagatcgatgccgagcaggcccagcgccgccccgggctgaagactggccgccagcgggtcgccggccggcacggcgcccaggatgctgagcaccctgggatcgggcgaggcgatgaagcccggcggcccggccagcaacgaggcccagggcagcccctgcccatcgaccgaggcgaccaccaggaattccagatccatgaaaaacagccggaacgggtcgggcagcgcggtcatgaacacctgggcgccgatcgacgccatgcgctcccccaggccatacagatcctgcaccgcccgctcgcccaggtgaaagccgatcccctcggcctctggccccgaagcccgtctgtcctcggtcatgaccgcgtctcccgtcagaggaacgtcgggcgatcatacaccggaaccggcgctaccgtgaccacaggaaggcgccggccggccgatcggccggctttggcccaaaaccggccggggtctgaccaaatccggtcacgtctttgtccgcggcggagccctgcgccgggtgctacatttcaatcaacacgaagcaagtcgaaagcggccgacagaaaaaacctgaccgccttcccgcaccggctttcgtatcccgcctcgcccggacatttcgggctggagattattcggaacaagatgactgcgaaacgactttacacgggtggcgtatcccatccggatgtcgcaggcaccatccgaaaagacaaggagatctgaaccatgggcagccttcttcattgggccatcgttttcctgatcgtggcgctggtcgcggcccttctgggctttggtggtgttgcaggcacggcaatggcgggcgccaagatcctgttctgggtcgcgatcatcatcttcgtcatcacgctggtcgcggggctgatgcgcaggggccgctgaccgccgctcttccttccgtctccctcccccgcagcacgacgggcggccggtttccggtcgcccgtcgtgcttttcaggcagggctcaggcagggttccgtgacatcattcgtggtcacgacgaagacatgtcagccgccggtcatctccgccacctgcggcacatccttgtcgccgcgccccgacagcgagaccaccatcaccgcatcgggcgtaagatcgggcgccatgcggatggcgcgcgccagcgcatgggccgattccagcgccgggatgatgccttccagacgggtgagcaggtggaacgcctccagcgcctcggcatcggtcgcgggcagataggtcacccggccgatctggtgcagccacgcatgttccggcccgatgcccggatagtccagtccggccgagatcgaatgggcctcggtgatctggccgtcatcgtccatcagcaggaaggtccggttgccgtgcagcacgcccggcggcccccggtcagcgaggccgcatgtttaccactctcgatcccgtgccccgccgcctcaatgccatagatcgcgacctctgcgtcgtcgaggaagggatggaacaggcccatggcgttggacccgccgccgacacaggccatcaccacatccggcagccgcccctctgcctccaggatctgggcccgtgcctcgtcgccgatgaccgtctggaaatcgcggacgatcatgggatagggatgcggtcccgccacggtgccgatgcagtagaagctgtcttcgacattggtcacccagtcgcgcagggcctcgttcatcgcatccttgagcgtgcgggagcccgagagcgccgggatgacctcggcgcccagcatgcgcatgcggatgacattgggcatctgccgggcaatgtcgacctcgcccatatagaccacgcaatccagcccatagcgggcgcagagtgtcgcggtggcgacaccgtgctggccggcgccggtctcggcgatgatccgcttcttgcccatgcgccgggcgagcaggatctggcccagcacgttgttcaccttgtgcgagccggtgtggttcagatcttcgcgcttcagatagatcttcgccccgcccagatgcgccgtcagccggtcggcgaaataaagcgggctgggccggccgatatagtgccggcgcatgtcgtccatctcggccgcgaaggcgggatcggccctggcctctgcataggcccgctccagcgccagcaggttgggcatcagggtctcggccacgaagcggccaccgaacatgccgaaacggccgttctcgtcggggccgttgcgcaggctgttgggcagatgagaggcgggctggggggacgtcatcggtcgaaaacctccggatcgggatcgctggagggtcgccgccccggatccccgcccctgtcgtgcgcataaacgacaaaggccgctctccggagtgagcggccttccacagggcatgacgactgccggtgaaaccgcccgcttacgcgggccaccagcggcgggtctgcatcgggcagaagatggggtgcagcatcgtcatgggctgacggtaacagagcggacggcgggggacaatgggggtcatgcgccgtctttccgcggaccgtcaccgcgtccggccggcgcgggcatgtctccgatcagatcaaggctggtgacactgagatcgctctgggcggccgccgcaagcggggccgcctcggcataaagccggtcttcatgggcctgcaatgcccgaccccggcgggcatggtcgatgtgagatgctggcaccatgtcgaatgctccgatgcgctcacgcaggaagggtcgctccatccagtcggatgcatcgatatagcccaggcagaattcggccacggctgccgcctgcacctcggagcgcatgtgaagcatggcggcctcgcggcgatcggcggtcttgcgccgcggatcatcttccgtatcgatccagatcagaggataagcttctccgcccagaatgcccttcagggcctcgcggccgtcatatccgaaacagaagggaagacgctgctgtgcatcgctctcggccagcagggcggccagttccaccgacagcaccatcttgcgccgggtcgcgaaccggccaaggcgaaagccggtgtccatcgacggaccgatgaaatcctgaatgccgcctacgccttcagccatctcgtcaaggaactggtcggcctccctcagtccgccgaggtcgatcatcatattgcgcgccggaaaatccgccacccagccacaggctttcaggtcgagactgcgcgagatctcacggaccacctgccgcgtctggtgaagtgccagaataaaatcgttgacgatgcccgcggtatcgtccaggtctgtaacggtaaagcgatagacgagttcgtcccccaaggctttccacaaccgcacccgatcctcggttccaaatcggatacgggtcttcttcagaaaggtctgatggaaagtaacatagaatttgcggatggcctgggaccatccttccgaccccgtctcgtcacgctcttcagtcccgcccgcgatggcggtcgaaaacttgaacgcgctggaccccaccatgtcgacgctgagaaaggcttccaggcgatagcgcgccgccgctgcggcaaggatctggtcgtcgccctgatcggcgctcacgggttgccgggccgctgcttacgccagacccaggctgcgtgcccggttctcggcagcctgacgggatacgaagaagcgttgtgcaacggcaccgcgatcgccatgcgtctcccgccaaaggtccgcaaaggggcccgagggcatcaggaaggccgccgcgaaccagttggcttcccattcgcagcgttcgacatccggcggcggattgtcaggcagatagcgggtggcagccatctcgacgctggcaccctgatgcgccttcttcacgaccggataatgcagcagcagatgccccagctcgtgcccgatggtgaaacggtcgcgggccggcgtggtctcgaaaggcaggtaaaggtcgaaatcgtctggcgcccgcacatgaatgctctcacgcggctgcggcgtcgcaaactccctgaaccggatccggccgcccatccggtggaccagatcgaacagatcatccccgggcagaaaattgatcttgcccgcgtatttctccgccgcctcctggatgacggccttgctcgcccgacatggcatcggcggaacgacggtcatctgcgcctcgcgatcgctgcctctcgttacaagatagcgaccgggccgggcggcgacaatggcgggcgatggtgcggcaaccgtttgcatcgcctgcgggaaagcgcgccgggcatatgcatgtcgggctgcaggaaggtggtgggcccggcaggattcgaacctgcgacaacaccgttatgagcggcgggttctaaccgctgaactacaggcccccacatcttccatggtgccggaacggggcggaatgccaccgccggttaccggcggcacaccttgtcgagttccgccgttttcgtcaagaggaagccggttcgtcacgagggggccgttcgtcgggagaaggctggcggaaatgacacgaccgccgccggaaggcccggcggcggtcgtgtcgtgtcgtcgatgccggcgttcgatcctagtgatcgaggaagctgcgcagcttgcgcgaccggctcggatgcttgagcttgcgcagcgccttcgcctcgatctggcggatgcgttcgcgggtcaccgagaactgctggccgacctcttccagggtgtggtcggtgttcatgccgatgccgaagcgcatgcgcagcacccgctcctcgcgcgccgtcaggctggcgagcacccgggtggtggtctccttgaggttcgaatggatcgccgcatcgaccggcaggatcgcattcttgtcctcgatgaagtcgcccagatggctgtcttcctcgtcgccgatcggggtttcgaggctgatcggctccttggcgatcttcaggaccttgcggaccttctccagcggcatctgcagcttctcggccagctcttccggcgtcggctcgcggccgatttcgtggagcatctggcgcgaggtgcggaccagcttgttgatcgtctcgatcatgtgcaccgggatgcgaatggtccgggcctggtcggcgatcgagcgcgtgatcgcctgccggatccaccaggtggcataggttgagaacttgtagccgcggcggtattcgaatttatcgaccgccttcatcaagccgatattgccttcctggatcaggtccaggaactgcaggccgcggttggtgtacttcttcgcgatcgagatcaccagacggaggttggcctcgaccatctccttcttggcctggctggcctcgcgctcgccgcgctggacgttgctgacgatgcgcttgaactcgttgatcggcaggccgacttcgcgggccagccgcgagatgccctcgcggatatcggccgcttcctcgccatggcgttccaggaaggtcttccaggccttgccgttctgcgcgcccaccacctggaaccagttcggcgccagttcctggccgctgtagagccgcaggaagtcttcgcgcttcacccggcagccgaccgccagacgcatcagctggccttccagcgacatcaggctgcggttgaggaggtagagttcctcgaccagcaggtcgatgcgcgcctgggcgaagttcaggccgcggaccatctcgatcacgtcggacttcgccgcctcgaaccggctgcgggcctgagtggtctgctcctcgcccttcagggccgcctcgagccgcttggcctgaagcttttcaagcttcgcccaggcctcgacgatcttgtcgaaggattccaggatcaccggcgtcagctcggcttccatcaccgagatcgacacgctggcgccgtcaccctcctcgtcctcctcctcttcggagtcggccgcgcggacggtttcgtcttcctcgtcttcctcgttgtcggacgccttgcggacctcgccctcggggcgcgccgcggctgccgccgccggggcggccgctgcaccattgccgttgaccacgggcttggccggctcgactgccggacggtcacccgccagcatcgcggcttcagcctcggcgtcctcgtcggtcatcggcggctggtcgccgccatagctggcctcgaggtcgatgatgtcgcgcagcatcgcctcgccggccgccagggcatcacgccagcgcacgatcgcccggaaggtcagcgggctttcgcagatggcaccgatcatggtgttgcgaccggcctcgatccgcttcgccagcaggatctcgccctcgcgggacaaaagctcgatcgaccccatctcgcgcagatacatccgcacggggtcgtcggtccggcccagttcctcttcttcgaccgaggtcgcgtgcgacccgccgaattcttcttcttcgtcgtcgccgctctggttctcgcccagttcctcgccttcctcgtcgttctcgacgacgttgatgcccatctcggagagcatggccatcacgtcttcgatctgctccgacgagagctgatcctggggcaacgccttgttcagttcgtcataggagatgtagccgcgctccttggcgcgggccaccatcttcttgacggtgatctcgagcgaatcgaccagcggtccatccggcgtgtcttcacgcccttcgccggcttcgacagccgtggtcgcttttttcgccattattcgtcgttcccccgctcagaaacgcacgctgcgccttgattccgatgcttgcccatgaggtcgatgccccgtccttcaacggccgtgaggcgccgctcccgcgatgatgacagcatcaccgcggcaacgacgccccgcgtcatcgccgaacccgccccgaccctcaaaggtcgaaaccgtcgctctgatcgaaggccgccagtccgcgctcgttgtcgtcaacgagcttcttgagcgcgacgaaccgctgcaaagcttcttccgtcatgctctcgacaagctcctgctctgcggccttcaattcgtcgaccagctgcgcatgccggtgtacagccagcacattgcgccatccggccagaaccctgtcgaatgcagctcccggccccgcgaacggtacacggccggcattctccgccgccgtcaaccggtccaccaggtccgaaaaccctcgcagtctcaaatggtcctgcagcgtttcactgtcaagaccggactccgatgcgtgcgtatctacgatcgcagcccgcaagatgtcaagctcaggggtggcgacgggcaaggcggccacctcgtcctccgccacctcaagcagttgaggatgcagaagaaccgccgccagaagcgccgcttcgcgccgtgccgactggccctcgtttccctggccgagcgccggggcggcgatgggcgtcgggtcgtcgttcagctgtccgggcctgggtttgccgccgcgccgctctccctgcggccgctggaaacccggccggccgggcgccgccggcccgccgccgccgcgtcttgcccggcgcagctgccagacccggtcgcggaagtcgcgacgatagaggtcgcggatcagcgggtcgcggatcgtgtcggcctgggccatcagatcggcttccagcgcggccagccgctcgggcgtgtcggtggcatggccttccagcgccgcctgccagagcaagtcgatcatcggctgcgggctggccacggcccgatcgaacgcccccaccccttcggcccggatcaggctgtcgggatcatggccgccgggcaggcgcacgaagcgcaggctgtggccgggcttcagcagcggcagggcacgctcggccgcacggcgcgcggcacggataccggcggcgtcgccgtccaggcacagcaccggctcgggcgccatgcgccacagttcttcgatctgatgttcggtcagcgcggtgccgagcggcgccaccgcatggggccggccggcctgaaccagggcggccacgtccagatagccttcgaccaccagcacggtaccggccttgcgcgcagcctctcgggcaaccggccagccatagagcacacggcccttctcgaacagcggcgtgtccgggctgttcaggtatttgggctcgccatcgcccagaacccggccgccgaaggcgatgatccggccgcgccggtcggcgatggggatgatcagccggccgcggaaatagtcgaaggcggaacggtcctcgcgccgccgtgcaaggcccgactcgaccagccggtccagtgcgatgccgcgctgctcgaaagtgcggatcagcacgtcgcgccggtcgggcgcatagccgaagcggaaccggccccagctctcgggcccgaagccgcggcggaccagatagtcgcgggccggcgccgcctcgtcggtgccgagccggctttcgaaccagcggcaggcctcttcgacgacgtcgaccagcccctcgcggcgctcggccttgcgcttcgcatccggatcttcggcgggaacggtcagccccacctcccccgccagccgctccacggtctcgcggaagtcgaacccgccgagcttcatctcgaaatcgatggcgtcgcccttggcgccgcagccgaagcagtaatagaagcccttgtcgtcgctgaccgtgaaactcggcgtcttctcgttgtggaacgggcaaaggccggtgtgctcgcggccgcggcggatcagcttgacccggcggccgaccacatccgacaggcggatgcgggcacgcagttcctcaatgaagccggggggcagcgccatggggtgcgggtcagccgggctggcagttgcgcagcaggcgcttggccgcagagctggcgcagcccaggtccatttcgggcccataggcggatttcagggcgtcgaccgtgcgccccagatccttcagccccttggcgcagcaggccgcgatcgtggcacgcaccgcggcctcgatctcgtcctccgacatctgcggcggcaggaagcggcggatcacccgctgctccagctgttcctgttccaccagttcgatgcggccggactgctcataggcaccgatgctctcgtcgcgctgacgcagcatggtacggagcatgtcgtggatctcggtgtcgtcgatcgcgtcccgccccctcacatgggcagcggcatcgcggtccttgatcgccgtccggatcagccggagcacagccagctcttcgctgttgccctgctgctcggcctgggcaagcgcgtccttgaggcgctcacgaagcatggaagtcgatccctcgataagacggaaaccggcgaccccgtcatgtcgcggccaccgaaagcccggctccggatgccgcagatcatgcagaagacggcggcatcgtggcggtgcgggcagttaacgggggcgcggacgatgtgacaagctttcatattgcgtgtcagcccccgggctttcaatggccggcacgcggacgccccccttgcgaaatcagcggagcccgcggcttgaccggggggaggggtttgcgtatggtccgtccggtcgatccggcgcccacccgccgggcgtctacgcacgcgccctcttcgctgccgcaaccgccttgcctgcctgccaggtcgttatacaggttgcgcccgtgaccccctccgacgccccgccttgtgccgcagtcctgcggccgggacgccggccggccgggtccgcgagccgggccagcgtccccggatggaccacgcattcgctatcatcggccgccttggggcttcccgggcggccgcgtcgcatcatcctgggggctcgctatcatgcaagaggcgtcgaactcgcccgccctggcggctacggccgccctcgttctggccgacggcacggtcttctggggcctgggcgtcggcgcacgaggcatcgccgagggcgagctgtgcttcaacacctcgatcaccggctatcaggagatcctgaccgatccctcttatgccggtcagatcatcaccttcaccttcccgcatatcggcaatgtcggtaccaatgacgaggacctggaaaccacgacgccggcggcgcgcggtttcgtccttaaggcgctgccgaccgagccgtcgaatttccgctccacccgccgcctgcaggactggacggcggcccacgggctgatcggcattgccggcgtcgacacccgccgcgtcacccgcctgctgcgcgacaagggtccgcagaatgcggtgatctggcatggcgaggccggatcggcggatctggacgcgctgaaggcgcaggcgaaggccgcccccagcctggaaggtctcgatctcgcgatcacggtgacctgcgcccagacctatgcctgggacgagaccccgtgggagctgggccagggcttcggccggcaggaaagcccgcgcttcaaggtggtcgcggtcgattacggcgccaagcgcaacatcctgcgctgcctggccggcaccggtgccgaggtggtggtggtccccgcgaccgcaaccgcggacgagatcctggcgcacgagcccgacggcatcttcctgtccaacggccccggcgatccggcggcgaccggcgaatatgccgtgccccagatccgcaggctgatcgagaccggcaagccgaccttcggcatctgcctgggccatcagctgctggcgctggcggtcggcgcctcgaccgaaaagatggaccgcggccatcgcggcgccaaccagccggtcaaggatctgaccacgggcaaggtcgaaatcacctcgcagaaccacggcttccgcgtcgtcgcctcgtcgctgccggccaatgccgaagtgacccatgtctcgctgttcgacgacacgctggagggcttccgcctgaccgatcgtccggtctttgcggtgcagtaccaccccgaagcctcgccgggaccgaaggacagccactacctcttcgaccgtttcgcgcgcctcatcgagaagaccaagaccgatgcctaagcgtaccgatatcaagtcgatcctggtgatcggcgcaggccccatcgtcatcggtcaggcctgcgaattcgactattcgggcacccaggcctgcaaggcgctgcgcgaagagggctaccggatcatcctggtcaactccaacccggccacgatcatgaccgatccgggcctggcggatgcgacctatgtcgagccgatcacgcccgaactggtcgccaaggtgatcgaggccgagcgccccgacgccctgctgccgaccatgggcggccagaccgcgctcaacaccgcgctcgctctgtcgcgcgacggcacgctgaagaagttcggcgtcgagctgatcggcgccaacgaggcggcgatcgaaaaggccgaagaccgccagctgttccgcgaggcgatggaccgcatcggtctgtccagcccgcgcagccgcgtggtccgcgacatggaatccgcccgcgaggcgatggagttcgtcggcctgccgacgatcatccgcccctcctatacgctgggcggcaccggcggcggcatcgcctataaccggcaggaattcgaagagatcgtggccagcggcctcgacgcctcgccggtgaacgaggtgctggtcgaggaatcggtgctcggctggaaggaatacgagatggaggtggtccgcgaccgtgcggacaactgcatcatcgtctgctcgatcgagaacatcgacccgatgggcgtgcacaccggcgacagcatcaccgtcgcaccggcactcacgctcaccgacaaggaataccagatcatgcgtgacgcctcgctcgcggttctccgcgagatcggcgtcgacaccggcgggtcgaacgtgcagttcgcgatcgaccccgagaccggccgcatggtcgtgatcgagatgaacccgcgcgtgtcgcgctcctcggcgctcgcctcgaaggcgaccggcttcccgatcgccaaggtcgcggccaagctcgccgtcggctacacgctcgacgaggttcagaacgacatcaccggcgtcacgccggcctcgttcgagccgaccatcgactatgtcgtgaccaagatcccgcgcttcgccttcgagaaattcccgggcaccgcgcgcacgctgtcgacctcgatgaaggcggtgggcgaggtcatggccatgggccgctgcttcgaggaatcgctgcagaaggcgctccgctcgatggagacgggcctgaccggcctcgacgagatcgaggtcgcgggcggcgccggcaccagcgaggtcgatgcgctccgctcggcgctggccctgccgaccccggatcgtctgctggtcatcgcccaggcgctgcgcgccgggctgaccccggaagagatccacgaggcctcggattacgatccctggttcatcgagcgtctggccggtctggtcgccaccgaaaagcaggtgatcgaggacgggctgccggcggatgcggccggctggcggcggctgaagtcgctgggcttctcggatgcacggctggcgacgctcgccggtctcgacgaagagatcgtccgtgcccggcgctggaaggccggcgtgcacccggtgttcaagcgggtcgacacctgcgccgccgaattcgaggcgcgcaccccctacatgtactcgacctacgagctgcccggcttcgacggcatcgtcgaatgcgaggcgcagccctcggatcgcaccaagatcatcgtgctcggcggcggtccgaaccggatcggccagggcatcgagttcgactattgctgtgtccacgcggcctatgccctctcggaagcgggctacgagaccatcatggtcaactgcaaccccgagacggtctccaccgactacgacacctcggaccggctttatttcgagccgctgacggtcgaggacgtgctggagctggtgcgggtggaaacctcgcgcggcacgctcaagggcgtgatcgtccagtatggcggccagaccccgctgaagctggccgagccgctggagaaggcccaggtgccgatcctcggcacctcgccggatgcgatcgacctggccgaggatcgtcgccgcttccagaagctgctgaacgatctggatctgaagcagccggccaacgacacctgccacagcgaggaagaggcgctggccatcgcccagcgcatcggcttcccgctggtcgcgcgcccgtcctatgtgctgggcggccgggcgatggagatcgtccatgatctgggcgggctgtcttcgtatatgcgccgggcggtgcgcgagttcggcaacaagccggtgctgctcgaccgcttcctgaccgatgccatcgaggtggatgtcgacgcgctctgcgacggcgagaccgtggtggtcgcgggcatcatggagcatatcgaagaggccggcgtccattcgggcgacagcgcctgcaccctgccgccctattctctcgacgacgagatcatcgccgagatccgccggcagaccgaggcgctggcgctcaagctgggcgtggtcgggctcatgaacgtgcagttcgcggtcaaggaccgggagatctacatcctggaggtcaacccgcgcgccagccgcaccgtgcccttcgtcgccaaggccgtcggccggccgatcgccaagatcgcggcccggatcatggcgggcgagaaactgggcgccttcgatctggccgagcgcaaggtcgaccatatcgcggtcaaggaagcggtcttccccttcgcccgcttccccggcgtcgacatcctgctcgggcccgagatgaagtcgaccggcgaggtcatgggcctggataccgatttcggccgcagcttcgccaaggcgcagctggcggcgggcgtgcgcctgccgacctcgggccgggtcttcgtctcggtgcgcgacgacgacaaggacgcgatggtagagatcgcccgcggcctgaaggcccagggcttcgagatcgtcgccacccgcggcaccgccagggtgctggccgatgcgggcatccaggtcgaactggtcaagaaggcccatgagggccggccgaacatcatcgaccagatcaaggaccgccggatcgacatggtgttcaacaccaccgccgggtctcaggcgatttcggacagctactcgctgcgccgcgaaaccctgatgaacaaggtgccctatttcaccaccgtcgccggttgccgggcgaccgttcaggcgatcgcggccatccgggccggcacgcttgaagtccggtccctgcaatcctattctgcctgagaaggccgcagaaaacggctgatcgacatgcggggccgatgaaaatcggccccgcatgtgttcctgttgtcgtgctgcaggtgcacagcgatctcgtgcacaaccgacgttcggctgccggaaagtccggccgccgcgcgctgaactgctgcggcatgaattcctgtcaaccgcggaacggcattccctccgacgatcgcctgaccgttcgacgaccaacgtggaaagcgtcatacccatggaaaaagttcccatgacgttggaaggcttcgaccgactgaccgccgaactcaagcatctgaagacggtggcccgtcccgaggtgatcaacgcgatcgccgaagcccgggcgcatggcgatctgtcggagaacgccgagtaccacgcggcgcgtgagcgccagagcttcattgagggccgcatcgccgagctggaggacaagctgtcccgctccgaggtgatcgaccccaccaagctgtcgggcgaccgggtcaagttcggcgcgacggtcaccgtcgtcgacgaagagaccgaggaagagacgagctacaagatcgtcggcgtggacgaggccgacctcaagatcggccgcatctccgtcacctcgccgatggcgcgggcgctgatcaacaaggcggtgggcgaaaccgtcgaggtcgcgacgcccaagggccgccgctcctacgagatcctgggcgtgagcttcaactgaagccggccacgccgccgaagacatgaagggccggccctcccgagcggaagggccggcctttcgtcttgcagaatgcctgtcgatcaggacagttgagcgacacgccagacggtcttggccatacgagcgagcttttgctgccacttgtccagccgctccggcgtccagtcctggttctcctcgacaagatcccgcgtcagtttcagcccgctctgccccaggatcggccgcttctccgcatagggcttattgcccagggctctgtttcgggccgtctcgagcatgaccatgttcccgagacgatagatgaaggtctccaggtcccggtcgggaaaggcatcccagcctccatttggcgactggggcaggatgtgctcgatcgtataggtcgacgcatccggatcgaactcgacgccaccattctgtcgctccagcctgcacaggatatagcggacgatcttcgcattgcggctttgggtcgtcttgatcgccttggccgcaaagtcgccgcgaaaggcatcgtcgctgcgatagatcgggcgaagcgccgcaagcaccggtccgagagccgcaagctcaccccggtgcagctgcagggcaacggcgtgatagacgcgctcctgctcattgggcgcctggctgccgataacgttgtagcgaaaagcgatcactgccgtggccgcaatcagcccttcgaaatcaccatccgacaatcggcgcttcgccgccatgagcatgggatagggctgacggaccgagaacatccgcagctcttgagcgctgcgacgacagtctgccgaccattgcgccgcctcggggtggatcagcgcaagataggcatccatgtcttcgtccatttcacgcagcagcccgaacacttggccgcggtcgcgcacgctcgatcggatgattttgaacagctccgactggcgggcgaagccatgccggctgttccagtgcatgcgcaggaagtccgggaagctctcgctgcccaggcggccgaccatgccctcccagcgccgctcaagatcatccatttcctgctgtgactgaggaccgcgcgccagcaccgagaacagatagttcttgagcagatcggtcgccgacagccggacaccccgcgcattcagcgtttcgaacaccttataggcattcagttcgtcggcgacggtgatcaccgtgaagaacagccggtcgctcatggtttcgatgaattgcgccagcgcgaccccctggtcctgctggctgcggacatgatcgcgcagagccttctcgaaccactcaaaccctttgcgcatggcatgggtcgagggcgggaagccgcgctgcggaagatgttcggccagaggaacgaggtgatcgcggtaatagccgtcattattgcggttgagcgacaatttgttatgcgtcgccagcgtcaccggatccagatatccgatataggtcgcgcgaaactggtcgagccgctgctgattcgcatcggcattgcgaccgcctgcaatatacgccttcagcaggcgcatggcggccaggatgatgagactgatcgtcgtcagccgctgctgcccgtcgatgatctcgaagatgcggttgtccgaggtctgaaggacgagatagcccatgtaatgtgccggctcgccgtccggggcgatcgagcccaggatgtctgcccaaaggtcttcccactcggcatccccccaggaatagtcccgctggaaccggggcacgcgataggtcaggccattgccgagcaactggcgataggtacgattctcggtgttgaaattcgttgccgccatgtcgctcctccggcccatctccggcagatcccgccagtgaaccctagcttcggcgagggctcggcgggattcaagtggcggccgtcactcccgcacctgccgcgccacgaagcgggcgagcggggggccgagcaggacgaccaggaagaagcgcatggtctgcagggccatgacgaagccgatatcgacgccgcggctggaggcggcgatgatcgcgaccgtatccagcccgccggggctggtggccagataggccgacagaaggtcgatgccggtcagctgcgtcagcacccaggcgaggccggcgcagaagccgatcagcaccgcgatcgagaccaggatggtgggcagcgccttcagcgcatgccccagtaccgcccgggtgaagcccaggcccacgctccaggccagcaccgcgtagctggccgccagcagccattgcggcagctgaatggtcaggaggccggtcgcgctgagcacggcgccgccgatcatcggcagcagcaggcctgccgccggcaccgggatcagccggcccgccgccacgccggccgcggcaagcgccagggtctcggcgaaggcgagcggctggatcggcgggaaccagacgatcggagcggcggctcccgccccccccgcccagcaggaaatgcgcaagcagggcggcggcaaaggccacgaacagcacgcgggtatactgcatgaaggcgacgagccgggcatcggcgccgaaggcttccgccatcaccaccatcgccgaggcggcaccggccgaggtgccccagacaccggtcgtgccgggcaggatgtgattgcgggcaatcacccagccgagcgcgccgctgagcaggatggtggagagcacgatcccgaggaagatcggccagtcttcggccaccgtcaccaggatctcgggccgcaccgagcctgcgatcatgcagcccagcaccgactgggccatcaggaaggtgatccgcggcatcttcagcccgaccccgcccagcgccagcagaatgcctgagaccatcggccccagcagcaatgccgccggcagctggatccagatcagccccgccgtcaccggcacagagacgatcggcagcagcagccagcgcagccagaggggaagggtcggcaacgacatcggatcggggttcttccgcaaacgaaaacggccgctttcacccgaaagcggccgttcggatcgttctgcaccgaaccatgatctgccacgcggcacaaccaccacccccgcccccaggggtctgcggtttccgcacggctcgggctcagtcgtcctcgccggtgggctcttcggcctccagcagctcgatcggcacccccggctcatacttcgaggtccggatggtgagcgaggtgcggacatggcgcaccggcggcgccgcggtcagccgggttgtcagaaaccgctgataggcgtcccagtccttggcgacgatcttcagcaggaaatcggtctcacccgccagcatgtagcactcgcggacctcgggccagctctggaccagcgcctcgaacttcttgaggtcgagatcggcctggctctccagcccgacccgggcgaagacggtgaccgagaagccgagatgttcaggatcgagttccgcgcgatacccgcgcacgaagcccgcctcttcgagggcccggacgcgccgcaggcagggcggtgccgagatgcccgcccgacgggcgagttccacattggtgatgcggccgtcggactggagatcggcaaggatcttccggtcgatggtgtcgagttttacccgcgccatagtgtcgctgactcccttcccccgtcacgggcccgtgcgtgcgggcgaacgtgatcgctgggcagtctatagcaatattacccggacccatagcggcagtttgcggttctgtcgcgacccatgggccattcgatggtcttcatctggtgccggtttcaggcgaaccgcggccgggggttgcccctcagcacccgaggcgaagcggttccgttccggcgccgcggactttatagtccaccggaagggctctcaagcacgaaacgatctttcaggaccgaccttccgtaatgtcataccgcaggcagccatgaccgatccgcgcaacacgggacagccgcagccgcaaccacacgtctgcgtgctgaccgacgaccgcgccggtaacaatgcgcaagccctcggcgttgccgaggcgctgggctggccgatcaccgagatccggctgtcctatacccggcttatccgcctgcccaatctgatccgcggcaccacgacgctcggtctttccacatccgccgctgcggcgctcgatgccgtggcggcacccgacatcgccatcgcggccgggcgccgggcgacgccggcgctccgccggctgaagcggcgctttccgcagatgatcgccgtccagatcatgtggccgggcgaacccagccgcgggctggacctgatcgccgtgccggcccatgaccgcatcgcccgcgaaagcgaccgcgacccgcggctgctggtgaccctgggcgcgcccaaccgcgtcacccctgcccgcctcgccgaggcggccggcagctgggagccccgcttcgccgccgccggcatgggggcgggcaaagcgccccggatcggcctgctggtcggcggcaccaccaagcgcatgcccttcggccccgaggatggccgccatctggcccggctggtcgccgatctggccgcccgccacgatgcccggatcctggcgaccaacagccgccgcagtggcgccgaggtgacagcggcgctgagcgacgtgctccaggccacacggccgggcgctttctggctccatgatgtggcaaagggcggtgacaatccctatttcggcatactgggtgtggcggatctgatcgtggtcaccggcgacagcatgtcgatggcctcggaagccgccagcaccggccggccggtcgcgatcctgcccataacgggggaggcatcgaaagaggcacggctgcaccgggcgctctacgccctgggtgcggcccgcccgctcgatgccgacttcgtcgcccggggtgagatcgcctggcgctacccgcccctggacgacgcccaggcggtggcggcgcagatccggcggttggtgctggcaaatccggccgtttcccgctagcttccccgcccctccctgctgccgccgggtagcgggggtcagggttcaggccgtccgccgcccgtcacatgtcctgctctggaaaggccgccacgtcatgagtgccacccatcgcaccaaggtcctcattctgggatccggtcccgccggcctgaccgccgcgatctatgcctcgcgcgccatgctggagccgatcctggtccatgggcttcagccgggcggccagatgacgatcaccaccgatgtcgagaacttccccggcttccccgacgtgatccagggcccctggctgatggagcagatgcagaagcaggccgaacatgtcggcacccgcttccatcacgacatcatcaccgatatcgacctcaagacccgccccttcgtcgccaccggcgacagcggtgaccgctatgtcgccgatgcggtgatcatctccaccggcgcccaggcgaaatggctgggcctgcccgacgaggaactcctgaaagggttcgggctgtcggcctgtgcgacctgcgacgggttcttctaccgcaaccgcacggtcgccgtggtcggcggcggcaacaccgcggtcgaagaggcgctctacctcaccaatcatgccgacaaggtctatctgatccaccggcgcgatgcgctccgggccgagaagatgctgcaggagcggctgttcgccaacccgaagatcgagatgatctggaatgccgtggtcgacggctatctggccggcggcgagccgcgcggggtgaccggcgtgcggctgaaggataccgccgatggcagcctgcgggacctcaatgtcgacggcgtgttcatcgcgatcggccatgcccccgccaccgccctgttccagggccagctggagctggacgaggaaggctatctgatcacccgccccgacagcacccgcaccagcattccgggcgtgttcgcggccggcgacgtgcaggacaaggtgttccgccaggccgtcaccgccgccggaacgggctgcatggcggcgctggaagccgagcgtttcctggccggaaccacccatgcgccggccgatgccgtcgcggaatgagcacatgcggccgcaccgaaaacggcgcggccgcgctcaggacctttgaagaccggcgcatcgcgccgtaagatcgtcgaaacaccagcagcggaccgggtgacggcagggagccagacgtcgccacccggcagcatcagcggagccgcgcgagcctgacatggactgggaccgggtcaagatcttccacaccgtcgccgaggccggcagcttcacgcatgcaagcgagttgctgaacctcagccagtcggcgatcagccgacagatcagtgcgctggaggagagcctgggcgttcccctgttccaccgccacgcccgcggcctgatcctcaccgaacagggtgagctgctgcgcaacaccgcccgcgacgtcttcgcgaagctgtccatggccgaagccatgctgaccgaaagccgcgaacgtccgaaggggccgctgaaggtgacgaccacggtcgccttcggctcggtctggctgacgcccaggattcacggcttcctcagcctgcatccggacgtcaccatcaccctgctgctggacgacagcgagctggatctgggcatgcgcgaggccgacatcgccatccgcatgtcgccgccccgccagccggatctggtcaaacgcaagctgatgaccatccggcacggcatctatgcctcgccggattacgtcaaccgccagggcatgcccaagaccccggcagagctggacgatcacaagctgatcgtcttcggcgaggacacggccgcccccatctccaacgccaactggatcctggatgcgggcgccacccccggcaaggcccggcggccgatcctgaaggtgaacaacatctatggcatcatgcgcgcggtggagagcggcctcggcgtcgcctcgatccccgattacatggtgcgcgagaacggcaatgtggtgcaggtcctgcccgagctggaaggaccgcaatcggaagtctacttcgtctatcacgaagagctgcgccattcgaagcgcatcgcggtcttccgcgacttcctgatccgcgagatcgaacagagcctgcgctgacgggcgacggcgacgccgtcatagatggacggacggggcggcagatggacggggcggcaggggatcagatgtcctctgccgcctcttccgttgaatcgtcattgattgccacgcggttgcggcccgagcgcttggcggcataaagcgccttgtcggccctggaaagcacccggtcgatatcgtcgccgggggccgagaagcgggccaggccgaagcttgcggtcagccggatctcatcgcccttccagggcatgcggatggcggcggtcgtggctcgcaggcgctccgccacctcgtccagctctgccgcgccgatccccggcagcagcacggcgaattcctcgccgcccagccggccgaccagatcatcctcgcgcagcgtttcggacatccggcccacgaacaggcgcagggcctcgtcgccggccgcatggccgaagcggtcgttgatcgtcttgaagcgatccagatcggccatgatcacgcccgaggaacgcccctcatggcgccactggtcggcaagatgggccgccacgtccatgaaatggcggcgggtggcggcgccggtcaactcgtcgaccgcggccagcgcctccagccggtgagccagggcctcgcgcgtgcggacctcggcttccagccgctggttcagccggcgcagttcatcctgcatgcgatccgagagacggaccaggcggcgctgttcccgatagccctggcgataggcacgcatcaacgtgcgcacgccgtcggagacctcctccagtttgcggagcatctcctcgctctgggcgatcatcgcctcttcctggtcgaagagcgagaaatcccccgtcgtcgccggctcgggcagggtcttcaccctggtcaccttgggcctggtcatctcacgtcatcccgatcagtcgccaccatctccgtccgcgcacatgatgaagtcgatgtgctccaggtcggatgcgaaatcctccccgaattcctccatcgtctcatcatccggagcaaagtgccagttcacagtgaccgtgcgtccatctgccgccgattcttccaacatctggaaaatgttcatcaaagctttcgcactcgatgagttgaagtagatcagcgagatgtccaccgtgacgctgggcccgtcttcggccaggaagctgcgcagcgcatacaggatcggcccgtagaaggcggcggcgtcctcagggtaggactcgcccgccatcgagaaccggccggcgaccggatcgaaacgcaccgccggcgaccggtcggtggcggcgatctcgatggcgaggggggagtcggaagcggtcatatgaacaccttgaggccatagaaggtggtctgagcgtcgatttcgaagaaatcatactcgatgggggcactggcacgacgggcgatctcgatcagcccgagcgtcgcgcccttgctgtcgacatcggggtcttccttcagcttctggcggtagagcgccttcagttcatccggcgacagggccgcgatctcggccagccgctggcgcaggcgcggcgcccgcgccgcgtcgatcacattggcgcagatcacgaagaaccggccgtcttccttgcccaccgtcacgatgcccgagcgtgcggcatcgtcgtcggggccatgggcatcatcggaatagcggatgatgttctggacctgctcgacgaagaccgagaacacccggcgggtcagattgcggtcggtggcgtcctgctccagcttgcggcgcagcgcttcccccaatgagaacagaatgccttcggacatgatgccgctatagatcagcatcagcttgttggcctgtatctgggtgcggaaatcgtaaaggtctcgggccagcacctctcggctcctcggacatatgccgcatcgcatgcgacgtcggcgcgttacggttcgtcgggggttggggtcggggtcggggtcggggttggagttggggggcctgcggtcgtgctgccatcggccagaggcccggacaggcgcggccggaaggccaccagggtcatatcgtcgcgccgggcctcggccccgcgccagtcgtcgagggccgccgtcagcgcccgcagccggtccgccagcggcagatcggcatgcatcgccagcagggtcgccatccggcgccggccgaacagccgccgcgacggcccgccgacatgatcggtcacgccatcggtccacagatggaagctctcccccggccggacctgatgaagatggaccggaatgcgtcccggcggcggcagggtccggtagcccaggctgcggcgcaccccggtgatcgacgagacaccgtcggggccgaccacggtcagcgacagcccggcgccggcgaaggcaaccgtcccggccgcctcgtcatagatgcagaccgcggcatcgaccccatcatccgaggcatcatgcccgcccggatccggccggtcctggcgcagccgcgcccgcagccgccggtccagctcccccaaaatcagatcgggtgccggcatgcccgccacgtccaggatcgccttcagctccgaggcgaccaccagggtcatgaaggcgcccggcacgccgtggccggtgcaatccgccagcaggatcaggcatttgccgtcgcggcgttccatccagcaataatcgccgcccaccacatccagcggctcccagagcagggcgatatcggccattgccggcgacagcaccgcggggtcgggcaggatgccctcctggatccggcgggcatagcggatgctctccatcacctggcggtttgcggtttccagctcgacatttttctcgaccagcgccgcctgggcatcctgcagcgcttccagcaggcggcgggcatcgtcgccggcacgcagccccgccaccatccggttgaaggcggcggccgcctggcccagctcgtcgtcggccggctcgtccagcgtggtccagctcttgtgttccacctggcgcatcgcccgcagcatccgccccagcggctgcacgaccagccggcgcatggcgaactgcacggtgatcgacagggcgccggtcagcagcagcaccgcgaaggccgccgtcgcgacctgaaggatcgcaatccggttcagctccccggtggcgaagaccacctccagcgtgccgaccttgatatgcccctgcggctctatgatcgtgcgcgcgacggtgatcgcgccgctgccgggctctggcggggtgccggtttcgaacagcatctcgtcattgtcgtccagcacccgggcgtagcggaacccctggtcgctgaccagtgcgtcgacctgtggctcgaacaccgtgcggtccagataccagagcggggtggcgatggcggcggcggtcagatcggtcagcacgccggcgcgacgttccagcgcccggcgctgatcggtccaggtgatccaggcgatgctgccctggatcagcagcacgatcagcatcaccaccggcagggtacgacggaacagcttggcggccagcgagcgcttcggcgcgcccgcggcctgcgcccgccccgtcgccgcccggcccattgccgcccgggacagcgtttcgcgtttctccgtcatgcccgcctccggcgcatcgcccgccgttcccccatcagtcttccccgagcctcaccgggtcaagcccataggcgcgccagagcggcgccagtcggccatcacgatcgagccgggccagaagcccatagatcgcggccgcatccgggtcccgccccggccgggtcagcacccgcagatcgtaaagctgatcggcctgatccgacaccagcagccgcgccagatcattgggccgatcggcaagatagcggctgaggaaggattgcgtcaccacgcctgcctctacccgtcccagcagcaccagttcgatgactgcggcattgtcgttcaccagcaccagatcgaaacggcggcgcatctggtccgggtcaccggcgaaatccgcgaaggcgtaatggtagcccagcatcgccgcgatcttggtggcgcggacaccggcaaaccaggatttgtcgcgtccggcatagagctgggcgatgaacacctcgcgatcggtcgcgatccttttggagacgtcgagggggatgtcccgccggctccagccccagccggccatttcgaagaacatgacgtcgaagcggctgcgagcgaaatcgtcatagcgtctgagcggcgtggtcggcaccagttggaagcgccatctgtcctgcgcccggttcagcagggcgatcaggtccaccgtcagcccgtgcggccccgtcccgccctcgccgaacgagacatagggcgcgaactgatagccgccgaccctgacgatcttcgggtcggcgctcgctgccatcgccgcctgacccaggacaccggccacggtgatcgcggctgccgccagcatcatcatcagccgatgcaacgcagttgacctcccgcaatcccattcataaaggcaatcggtgacatgacgggatacggcaagagtggcccgttcacgacggtggagattatcaacaatgcacgccaatgcctacagcatgcggcggtgccggctgccgtttcacggctggattgcatcatgtctccgcagcacggaacgagacgctggttcgtgctgcgtaaagcagtggtgacctgctgctcttcatccgtctgtcacaatgcttacgcgcaaaaagaagccatgcacaacgtgcatggctgaactgacgtcgtgcctctggcacttcgacctcaggcgtcctatatgcactgcaacatcgtcgaggttagcctccgatgccacggaagccggcggctcccccgcttgtttccgcgtccgggtctccccccggatgtcaggtctccctgacctttttgcgtctcccagacgtgaagcctccctgtcagacttcagccgggccttcgggcccggctttttttttttgcggccgggcctgcaaatacgaaagcccgggcggggatgtctggccggccccgcccgggcctgtcggttcaatccgtcagtctttgctgactgtcggtttttgctgagcttgtcggttgttatgcatcgcgcgtctcgtcgcgaggcccggttcgtcccgggccggcagctcttgcggctgctgctttggtcatccggcgccatcttcggacgtccggaaaagatgggcgtttcctcctgcaccacatcggaccggcgcagcatctgccgcagcggaagtgcgaaagacggaagcggccgacgggcctgcgcaacggttccgcaaggggcctcccctcccctcgggactgcagcacccgaaggatgctgcagcgatgcgggcgctcaccatgcccggagggtcactccggggccgggcctggatccgggacgtgtctcgcgcgccccggcgtgtcgtgtgcgctgccaggcctggcaggatgatcgcagatccgcagtcgcttcgctgcgcggccaacatcggccgttccgtccatcagaccgtcggcgaacctccccagctccgccttcagcctgtcgcgaccgtcttgtcgtccggtccgacgatgtgcgccaatatgacgcagcccgccgttctgcgcaagtccgttctgcgtttgctgcatagcggaatggcacgaagcccggcggactgtcttctgtcgttgaaactttggcgctgcgggatagccctgtccggcttcaacggaacaggcggtcgccgtcgcggatatcggtatagagcccggcgacctgatcgccataaccgttccacttcagcgtcgggatctcttcgccggtgtcaatcacctgctcgcgcgcctggctccagcgcggatgcgacacctcggggttcacattggcccagaaaccgtattcctggtcctgcagctgctcccagaagctgaccggacgctcgtcggtgaaggtgaagcgcacgatcgacttgatcgacttgaagccgtatttccacggcaccaccagccggagcggcgcgccgtgctggcggggcagcggcttgccgtagatgccggtggcgatgaaggccagatcattggtcgcctcggccatggtcagcccttcgacataaggccagggcagccagatcgagcgttggccatgggccatctcgcgatcctcgaaggtctccatgcgcagatatttcgccccggccttgggctgtgccagcttcaccagatcggccagcggaaaaccgctccagggcacgaccatcgaccaggcctcgacgcagcggaagcggtagatccgctcttccagcgccatgcggcggatcagggcatcggcatccagcgtctgcggcgcatcgaccatgccgtcgatggttaccgcccagggttggaccttcagcttctgggcatcgggccagatccgcttgtgggtgccgaattcgtagaagttattgtaggacgaggcggtcttttccaccgtcaccggccggcccggatcggcataggccgggttggtcttcacggggtaaagatcgccccagggcgtgtcgggggtggggtcccccggctgataggcaaaggcgcggccgggcatcagcaggccgccgcccagaccgcccgcgaccgcccccgccatgcccagccccagccctttgagtactgcccggcggtcgcgccagacggcttcgggggtgacggcacgctcgggcagctcccagctgcggcggcggatgatgcgcatgggtccggctcctgacctgcggaaaacacgggcgacgttcagggagatacgcgccttcccggataatggatgccgcgaccgcgcgcgcaaaggcctcacggccccgctcacgcaggcgtgatcatcctcggcaaaagcgaaccccccggccgcagcgtgcgaccggggggcgtcgtcagaaccggatcctgcggaagctgccggatcagaccagttcgttgcaggcgcgcgcgatgcggccgcaggcctcttccagcacctcgtcggccgtggcgtaggagatgcggaaataggggtccaggccgaaggcagcgccgtgcacgacggcgatgccgacatgttccagcagataggtcgcgaagtcttccgacgagccgatcacctggcccgacggggtcttcttgcccagcacgccctcgcaagacggatagacgtagaaggcgccttccggcaccgggcagaccaggcccggtgcctggttcagcaggcggacgaccaggtcgcggcggacctggaagcgggccgcgcgctcggcgatgaagtcctgcgggccgttcagcgcctcgacggcggcggcctggctgacggaggacgggttcgaggtcgactgcgactggatcgccgtcatcgccttgataatgttggccgggccgccggcatagccgatgcgccagccggtcatcgaataggccttggagacgccgttgaccgtcagcgtgcggtcatacagctcaggggccacctgggcgatggtcgcgaactcgaaaccgtcgaacaggatgtgctcgtacatgtcgtcggtcagcaccagcacatgcggatgacggaccagcacatcggccagggcccgcagttcggcagcgctgtaggcggcgccgctcgggttgctgggcgagttcaggatcagccacttggtgcggggggtgatcgccgcttccagctgtgcgggctggatcttgaaaccggtttcgcggccggcctcgacgaagaccggcacgccctcggccagcagcgccatgtcgggatacgaaacccagtacggcgccgggatgatcacctcgtcgcccgggttcagcgtcgccatgaaggcgttgtacagcacctgcttgccgccggtgccgaccacgatctggttcgccgcgtaatccagcccgttctcgcgcttgaacttgttgcgcaccgcctcgaccagcgcacgggtgccctgcaccggcgtgtacttggtctgaccgtcgcggatcgccttgatcgcggcgtccttgatgttgtcgggcgtgtcgaaatcgggttcgcccgcgcccaggccgatgatgtcgcgcccggcttccttgagctgggcggccttggcggtgacggcgagcgtcggcgacggcttgattcgggacaggcggtcggcgatcacggacattggatcggctcttcggctggggactggagggatgagcgacatgccgaccggtcgcgagacgacgctcgggcgcgcagcagaggtcgtgcggcaacgtactcccgccccccggggctttcaacggaaaagccctcatgcaaaaggggggctgacctgctgacatctcctgtcaggaggcggcaccgtccgctgcactcaatcgctgaaaatcctgccgaagatcctatatatggcagtggtcccgctgcccgtgcgacgaccccgcgtcctgaccgtctggagacccgatcgcccatgcccgtcctgatgcccggccgcaccttcgacgaccgcgaggtcccggatccgatgccgacccgtccgacgggccgggcagatttcaatctggtcagcgctttcgagccggccggcgaccagccgaccgcgatcgcggaactgctcgacggcatccgcggccaggaacgcgatcaggtgctgctgggcgtcaccggctcgggcaagaccttcaccatggcccaggtgatcgccgccgagggccgcccggccctgatccttgcgccgaacaagacgctggccgcgcagctttatggcgagatgaagcagttcttccccgagaacgcggtggaatatttcgtctcgtattacgactactatcagcccgaagcctatgtgccgcgctccgatacctatatcgagaaggaagcctcgatcaacgagcagatcgaccggatgcgccattcggccacccgcgccctgctggagcggcgcgatgtggtgatcgtggcctccgtgtcgtgcatctacggtatcggcgcggtcgaaacctatgcccggatgacgctggatatcaggaagggcgagacgatcgaccggacggtcctgctgaagaagctggtcgagctgcaatatcgccgcaacgatgccggctttcagcgtggtgccttccgggtgcgcggcgatgtggtcgagatcttccccgcccatctggaagaccgcgcctggcggctgagcctgttcggcgacgaggtcgaggcgatcgtcgaattcgacccgctgaccggcgagaagaccggcagtttccccaaggtgcgtatctatcccaacagccattatgtgacgcccaagccgacgctggcccaggcagtcaagcacatcaaggaagagctgaaggcgaggctcgcccagttcgaggccgagggcaagctgctggaggcccagcggctggaacagcgtaccaccttcgacatggagatgatcgaggcgaccggttcctgcgccggcatcgagaactattcccgctatctgtctggccgggcccccggcgagccgccgccgaccctgttcgaatacctgccggaggatgccatcctcttcgtcgacgagagccatgtgaccgtgccgcaggtgggcggcatgttccgtggcgactttcagcgcaaatcggtgctgtcggattacggcttccgcctgccctcctgcgccgacaaccggccgctgaaattcgaggaatgggacgcgatgcggccgcaatcggtgttcgtgtcggcgacccccggcccctgggagctggagcgcaccggcggcaccttcgtcgaacaggtcatccgtcccaccgggctgatcgatccgccggtgatcgtgcggccctgcacccgccaggtggacgatcttctggccgaggcgcgcgataccatcgcgaagggctaccgggtgctggtcaccacgctgaccaagcgcatggccgaggatctgaccgaatacatgcacgaggccggactgaaggtccgctatctgcattccgacgtcgagacgctggagcggatcgagatcatccgcgatctgcgcaagggcgtgttcgacatcctgatcggcatcaacctgctgcgcgaggggctggacatcccggaatgcgcgctggtcgccattctggatgccgacaaggaaggcttcctgcgctccaagacctctctggtccagaccatcggccgcgcggcacgcaatgtcgacggccgggtgctctgctatgccgaccacatgaccgaaagcctgtcctacgccattgccgagaccgaccgccgccgcgccaagcagatggcctataaccaggaacacggcatcacgcccgaaagcgtgcgcaagaccatcggcgatgcgctgggcagcgtctacgaggcggactatctggaagtcgaggtcgaagaggccgatcagggccatctggtcggccacaacctccgcgcctacaaggaggacctggagaagcggatgcgcgccgccgctgccgatctggagttcgaggaggcggcccggctgcgcgacgagctgaagcgcctggatgctgccgaactgggcctggccgagggggccggcccggcgctcgccccgcccaaagggcgcggcggccggctggactcgcgggcggcccgggtcgcgggcggcgccaagaccggcggccggcgcggcgcgctcaaatccggcaagcccaccgggcgcaagcgcggttgatcgcggcccgatcgccatggcgtgagttttaccacagtccctggcccgaaaatcgatccgccccctggaaccgcgcgtaggagaagcggcagccccgtcgtatcatcgccgttgcgcagcgccgggcatcgggtccgggcggcgcgacgggaccgtattcggggcatgacggcgccggacggacacgccgaagggcggccacggatgccgagtgggggaagcaggacgtgcggatcatcgggcagatcatcctgatcgcggggcttgccgcggccggcgccggcgcgtggtacggctgggaccgcctggccggcggcgaggccggcaaggcctcggcgacggtgacgccggcgaccgtgcggccggtgacggtcgaactcgccgccgtgacgccccatcagctcgcccgcgtggtggaagcggtcggcaccgcccgcgccatggatgcggtgacggtcgccaccaagatttccggccggatcgcagagctgaacttcaccccaggcaccacggttgaagccggccgcgtgctggccgcgctcgatgatgccgcggcgcgcgccaatgtcgcccagctggaagcggcggtccacgaggcccagacccagctggagcgcacccgtcagctgcgccagcgcaacgccgtctccgccgcggaattcgacacccgcaccacctcgctggcgggcgcccgcgcccagctcgcggccgcaagggccgagcttgccgatcacaaggtggtggctcccttctcgggccgggtgggtctgcgtcaggtcagcatcggtgcagtggtcggccccgataccgcgatcaccacgctggacgacatcgacccgatcaagctctctttcgcggtgcccgaaaccgctctcgcccagctcagtgccggccagaccgtggccgcccgcagcgccgcctatcccgacgaagccttcaccggccgggttcagttcatcgacacccggatcgatgtggcgacccgtgccgtcacggtggaagccgcggtcgacaaccccgacgggcggctgaagccgggcatgttcatggccgtcaccctcaccctcgaccccggccccgacgtgccgaccatccccgaggccgcgatgatccgcgaaggccggctcgcctatgtctatgtcgccggcaccgatggcgtcgcccggcggcggatcatcgagcccggccgccgtcaggacgggctgatcgaggtgctgaaggggctggagccgggcgaaccggtggtggtggccggccatcagcgcctgcgcgacggcgcaccgatcaccgttgcaacgggaaccggcgccccgccggccaccgccggctgatgccctccccgctgtcgatccgggtgccgtcatgatcctgtcggatgtttccatcaagcgcccggtcttcgcgaccgtgctgtcgctgctgctggtggtgctgggcctctcggccgccatccgtctggcggtacgcgaatacccggatgtcgacacgccggaagtgtcgatctccaccgcctatcgcggcgcaccggcctctctggtcgaaacccagatcacagaaatcgtcgagggcgcggtcagcggcatcgagggcatccgcagcatgcgctcggtcagccgcgacggccggtcctatgtctcgatcgaattcaatgtcgaccgcgacctggaagccgcgaccaacgacgtgcgcgacaaggtcgcccaggtgatggacgacctgcccgagaccgccgatcagccgatcatctccaaggccgatgccgatgcccgggcgatgctgtgggtgacgctgacctcggatgcgcgggattcgctggcgctcaccgattatgccgaccgctatatcgtcgaccggctgtcggtggtgccgggcgtcgcctcggtctatatcggcggcgagcggcgctatgcgatgcggatctggatcgaccggcaggcgctggcggcgcgcgggctgaccgtcaccgacatcaccgccgcactcaatcgcgagaatctggaactccccgccggcagcatcgagaccaccaatcgcgaggtcacgatccgcaccgacacccgcttcgccggcgaggatgatttccgccgcctgatcctggccggcggcaccgacggcagcccgatccggctgggcgatgtcgcccgggtggaggtcggcgccgaagactacaagaacgagatccgctccaacggcatgtcgggcatcggcatcggcgtgatccgccagtcgaaggccaatacgctcgacgtcgccaatggcgtgcgtgccgagatcgagcagatccgcaccagcctgcccccggacatccgggtcgcctattcctatgacgagagcctgttcatctcggaagcgatctacgaggtgatgcatgcgctggtgatcgcgctgctgctggtggtcggcatcatcttcatcttcctgcgctcgatcgcggccaccctggtgcccgcggtggcgatcccggtttcggtgatcgcgtcgctcaccgtgctgggggcgctcggcttctcgatcaacgtgctgaccctgctggcgctggtgctggcgatcgggctggtggtcgacgacgcgatcgtggtgctggagaacatccatcgccgcatcgaggaaggcgagccgccgcttctcgcctcgctgcgcggctcacgccagatcgctttcgcggtgatcgcgacgaccctggtgctgattgcggtcttcgtgccgatctcgttcatggaggggcgcaccggccggctgttcggcgagttcggcatcgccatggcgtcttccgtcgccttctcgatgctggtcgcgctgaccctgacgcccatgatgtgcagcaagctgctgagcgcaccgggcaaggccaatgccgccgagcggctgagccagcgcttcttcgacggcatgaaccgggtctatgaccgcatcctgggctgggcgatggcggcgaagctggtggtgatcgcgctcgcgatcggcatctcggtcgtcgccggcatcctctacgacgtcatcccgcgcgaattcgcgcccaccgaagaccgtggcagcttcatcgtggttgtccaggcgcctaagggggcgagctacgactacaccagccgcaatgtcgaaaaggtggaagagatcctgcggccgctggtcgatcgcggtgtcgcctcgatcgtcttcaccatcgtctcccccggctccaaccgcccctcgccggtggaccgcgccttcgtgatcgtgcgcctggcgccctggtcggatcgcgatgtccgtcagaccgatctggtgcgcgaggtgctgcccaaactctcggcggtgccgggcgtgcgggcggtgccggtcaacccgccggggctgggccagcgcggcttctcggacccgctggaagtggtggtcgccgggctcgaccgcgaggacgtgaaggcatgggccgacatcatgctgcgccggcttcaggacaatccgcagctcaccaacgtcaataccgactatgaagagaccaagccccagctcgacgtctcggtcgaccgcgagcgcgcggccgccctcggcatcacggccgaagagatcggcggcacgctggaggtgatgttcggcagccggaccgtcacccgcttcgaggatcgcggcgagcagtacgacgtggtgctccaggccgccgatgccgatcgcgccgcggcccgcgacctttccaacgtcttcgtgcgcgccggcaccgacggctcgctggtgccgctgtccaatctggtgcgcatggaagaggtggcggtgccgccggagctgcgccgcgtcgaccgcctgcccgccatcaccatcgaggccggtctcgccgacggctacggtctcggcaatgcgatcgaagaggtccgccggatcgcggccgaggaactgccgacggctgcccgcgtcactttcgacggccagtcgcgcgaatatgtcgatgccggcgccggcgtgatgatcgtctttgcgctcgccatcctgatcgtgttcctggtgctggcggcccagttcgaaagctggatccacccggtgatcatcctgctggcggtgccggtggggcttacggggggcctggccggcgtctggctctcgggcggtaccttcaacatctacagccagatcggcatggtgatgctggtcgggctgatggccaagaacggcatcctgatcgtcgaattcgccaaccagctccgcgacgaagagggcctgtcgccggccgccgccgcccggaaatcggccgtgctgcgcctgcgcccgatcctgatgacgaccatcgcgaccgtgctgggcgcggtgccgctggccatgggccatggcgccggcgtggaaagccgcagtgcgctggcggtggtggtgatcggcggcatgtcgctcgccaccatgatgaccctgttcctggtgccggtgctctatgcgatgctggcgggcttcacccgcccggcgggctcgatcgcaaagcgcctgaccgagcttgaccgcaaccacccctcggcccatgtcggtcccgagagccatggcggtgcagatggcaccgccgcccgcgaaaccgggccaggccgcccgttgcccggccccggggaatgaccccgggggcggcatcatcgggggccgggcgtcgtttcggtccccgacaccaaacacggaccccgacatgaccaccagcccgacatcacgtcccgcagacggggcccgtcccctgcccgccctgccgcgcgctgccctcgtgaccggcgccggaaagcgcatcggccggcgcatcgcgctcgacctcgccgccgacggctatgcggtcgcggtgcactacaacggctcggccgaggcggccgaggcggtgtcggccgagatccggagcggcggcggccgggcggtggcgctgaaggccgatctggcggtcgaagacgaggtcgcgacactgatgccgcgggcggtcgacgcactggggccgatcggggtgctggtcaacaatgcctcgaccttcgaatacgacgccgtcaccacggccacccgcgaaagctgggatttccatatggaggtcaacctgcgggcgccgttcgtgctgtcgcagggcttcgtgcaacagctgccggccacggccggtggcgcgatcgtcaacctgatcgaccagcgggtctggaatctgacgccccatttcatgacctacacggtcagcaaggccgggctctggacgctgacccgcaccctggcgatggcgctggccccgcggatccgggtgaatgcgatcggccccggcccgacgctggccagcattcaccaggacgatgccggcttccgcgagcagtgcgagaagatgccgctccggcgcggcacctcgcccgaggagatttccgaggcggtgcgcttcctgatcggcgcccaggcgatgaccgggcagatgctggcgctggatggcggccagcatctgggctgggcccagccgccccatgcacatgatgcggcactggactgaagctcgacgcgacgcgccgggcggtgtaggactcctgccgcccgggccggtcttccggtaccgcctgcgatctgatgccgcccccatccgggagagccccttgaccgatccgatccaattgcgtgccgtcccccagccggaccaccggccgtcgcgacgccgcctgttcatccgcgatctggtgatcgcctgcgatatcggcgtccatgcgcatgaacatgggcagccgcagcgggtggcgttcaacatcgacctcacgctgcgcgatgacggcccgccgccggcggatgatctgtcctgcgtgctgtcctatgaggatctggtggtcggcatccgggcgcttgccggcagcggacacgtcaatctggtcgagaccctcgccgaacgcgtggctgccctgtgtttttcggacgatcgcgtgctggtggcacgcatccggatcgagaagctcgacgtgttccacgatgccgccggcgtcggtgtggaaatcgagcgtatgcgcgcctgagcgctgccggaacgagcttgcgcaagcggatgtttcctcatgccgaatcgttcggcgtgactgcgatcgtatgccatcgcgtcccctgaacgaggcgggaacgccatgcagccggcgcaacaccagcttttttttgcacaggggccccacaataaagcgcttgacagcgaatcggcgggctaagcccttgatggtacgtggccagcagcccattttgacaaaaaagacggaaaatcaaagacttaacatttgcctgttttttgggcaaagcgatggaaaaccaagcggacggccccgtcgcaccggccctcaacacgatatacacatggttatccacagtttccgtggatatgttgacgatcagatgacgcttgtgagacggacatgaccgagcggcccgaagatatccaccgccccgctgccgcagaggcggccgaatccgctcctgccgcgaccccatcggcggagagcggggccgaggacatcgtctgggaaggcgatgcggccgcactcgacacgcctgccctcacccgccttctgacccgccgcgccgcagcacccgaagatgcggcaatgcccgccgccgacggcgacgccgaagacgatgcggaggatggcgacgacgccgaagatgcggaggacgacggcgctgccgagaccgcgtccggggatgccccgacggaggatgcgccctcggaggatgcgccatcggaggatgcgtcaccgggccggccccagcgcagccgccggccgcgccacgaacagggtgatccgggctgggtgcgtctggaggcgggcgatgcggaggatgacggcgccgacggcgacgacgctgccgaggacgagccggacgacacaccggccacacaggcagacgtcccggaaccgacggccgcggcccctgaggccaccgacgggccggcgccgaccgcccgccccctctcccgccacccgcagctgcggaccggccgtggggccatcctggcggcgctgaagaccatgcccgacagccccggggtctatcggatgctcgacggccatggcgacgtgctctatgtcggcaaggccaagcatctgaagcggcgggtggcgagctatacccggatcaaccagctgcagccgcgcctgatgcggatggtggccgagacccggaccatggagatcgtcaccaccgcctcggaggccgaggcgctgctgctggaagccaatctgatcaagcgcctgcgcccgcgcttcaacgtgctgctgcgcgacgacaagagcttcccctacattctgatcaccggcgatcacgacttcccgcagatcctgaagcatcgcggcgcccgcaaccgcaagggcgagtatttcggccccttcgccagcgccggcgcggtcaacgaaaccctggcggtgctcgaaaaggcattcctgctgcgcaactgctcggattccgtgttcgaaagccgcagccggccctgcctgcaataccagatcaagcgctgcagcgcgccgtgctgcgcctatgtcgaccgcgagagctatggccggctggtggccgaggcccgcgacttcctgcgcgggcgttcggccggcgtccgccaggcgatgcaggaccgcatggccgaggcggcgaacgatctggatttcgaaaccgccgcggtctatcgcgaccggatcaaggcgcttgcccgcgtcaccgccacccaggggatcaatttccaggggctggaggatgtcgacgtggtggcgatcgccgaagagggcggccagagctgcattcaggtgttcttcttccgcggcggccagaactatggcaaccgcgcctatttcccggccaacgaggccggcagcacggcggccgaggtactctcggccttcctcggccagttctatgccgacaagctgccgccacgagaggtggtgctggaccgcgaacccgacgaggccgatctggtcgcccaggccctgtcggtacgggccggccacaaggtgcggctgaccgtgccccggcgcggcgacaagctccaggcggtcacccatgccgccaccaatgcccgcgaggcgctgggccgcaaactggccgaaacctccagccagaagcggctgctggaaggcacgcgcaccgtcttcggcctggagcgggcgccgcagcggatcgaggtttacgacaacgcccatatctcgggcacacatgccgtctgcggcatgatcgtggcgggccccgagggcttcgaccgccggtcttatcgcagtttcaccatccgcgacatcgacccggccaaggccggcggcgacgattatgcgatgatgcgcgaggtgatgcgccgccgcttcggccggctggcccgcgagttggacgaggccggcggcgagaccgaccgcgtcgccggctggcccgatctggtgctgctcgacggcggcgagggccagttgcagaccggcaccgaagagctggaggcggcggggctgaccggccggatcatggtcgcggccatcgccaagggtcccgaccgcgatgccgggcgcgaacgctttttcctgcccggccgcgcgcccttccgcctgcccgaacgcgacccggtgctgtattttctgcagcgtctgcgcgacgaggcgcaccgtttcgccggcggccagcatcgcgcgaagcgcagccgcgccatcggcacctcggcgctggacgagatcccggggatcgggccgaagcgcaagaaggcgctgctgcaccacttcggctcggccaaggcggtggaggcggcgagcctgaccgacatcgcccgggtcgagggcatctccaccgccgtcgcccgccagatctacggcttcttccatcccgaaggctgatcgcgcccgccgaaggctgacggcgacgcccgccttcctgtagactgacccgcggccccaatcgcgacggatcccatgcgccagagcctgcccaacattctcaccctgtcgcggatcgtggtgatcccgttcttcatcgccggcttcgcgctcgatgcgccggcgggcgcctgggtcaccttcggcctgttcgccgccgcctccgtcaccgactggttcgacggctggctggcgcggcgctggggtgtggtctcggcggtgggccggttcctggatccgatcgccgacaagctgctggtcaccgccgccctgctgatgctggttgccgacggccgcgcccatcccctgcccgcgctgatcatcctctgccgcgagatcctgatttccgggctgcgggagcatctggccggcgaccggatcgcggtgccggtctccaaactcgccaagtggaagaccacggtgcagatgatcgccatcgccatcctgctgctgctgccggcgctgggtggctgggcctggtgggcgggcgagaccctgctctggcttgcggccgcgctgacggtggtgaccggctggagctatatgcagggcggcatgcgccatcttcttgccgccgaccgacgctgatggagacgccccccatgcccctgcagatcctctatttcgcctggatgcgcgcccggatcggccgcggtgaggacgagatcgcctggacgccggcgctgtcgaccgtgggcgccctgctcgaccacctggcgggggtaagccccgcccatgcccaggcgctggccgacaggtcggcggtgcgggtggcggtgaatcaggattatgccggccccgatgccgcggtccgggacggcgacgagatcgcgatcttcccgccggtgaccggcgggtcgggggcggaggccagcgcctgcgcgatcgacatccgggtccagacggcggatttcgatgtcggcgccgaatatgccgccgcggcgaccggccctgcgaccggcggggtcgcgctgttcgtgggccaggtgcgcggccgggacggcaccgacgaggtggcggccatgaccctggagcactatcccgggatgaccgaacgcgagatcgaccgcatcgcgcgggaggccgcggaacgctggccgcttcaggccatccgcatcatccaccgcgtcggccggctgatgccgggggatcggatcgtgctggtgattgcggcttccgcccatcgggcggcggccttcgatgcctgcgccttcctgatcgactggttgaagacccgggcgccgttctggaaactggaagaaacacccgacggggaacgatgggtggctgcgaagtcgagcgacgacgccgccgccctcagatgggagacgccttcggacggaaaacggggagctgcgtagggaaccggcgggggccgcgtgaaagctacaggaacggggcaggacgacgcccggttcttccaacggttcgaaccgccgctctcaacgcccccctcaccggaagacggtgaccccaggagatccgatcccatgacccgcaacagcttccgcaagactgccttcgccgccggcgtcgccacccttctggcactgcctggcctggccattgcggccccgggcgacggccccgatggccagggcatgaccctggaacagatgcaggcacgcaccgccgaacgcttccagaagctcgacaccaaccaggacggccgcgtcagccgcgacgagatgaaggccgggcgcgcgatgatgcacgacggcaaggccggcgacggcatgcccggctggagccacaagggcccgcgcggcgaccatatggcacgcatggccgacaccaatggcgacggcatcatctcacgcgatgaattcatggccggcgccgacaagatgttctcgcggctggacgccgatggcgacggccagatcaccagggccgaacgcgacggcgcccgcgagcggatgcgcgagtacatgcgcaacaacggcccggccgccgacaagccggccgatgcgccgaagaccggcgggtgatcatggtcgcatcctcgtcggataccggggccgccgggcggccgcatgacgaggacgacctcctgctggcccgcgtggccgcaggcgatgccgccgctttcgggcggctggtggaccgccatggcgagcgtgcgctcgccgtggcgacccgcatgctcggcagccgtgccgacgccgaagacgccgttcaggatgtctttacccgcctctgggcgggggcggcggcacggtggcggccgggcggcgcgcgcttcggcacctggctctggcgggcggtggccaatcgctgcctggaccagctgcgccggccgcgcatgggtgaactcaccgacgcgatcgacccgcccgacccgtctcccggcgcgctggagcgcctggaacgggaccgggtgctccgccaggtgaccgatgcgatccagaccctgcccgaacggcagcgcatggcgatcgcgctggtctatgacgccggtttgaacggcgccgaggccgccgaggcgatgggggtcagcgccggtgcgatggaacagcttctggtcagggcccggcgcagtctgcgcaccgggctccggccactgatggacgaagaagacaagggaggcgcgtgatggatatcgacagcttccgggcgttgctggacgcccatggcggcgatccggcgcgctggcccgaaaccgcccgcgacgatgcgctggtgctgctggcgacagaacccgccgcccgcgcggtgctggacgaggcccgccgtctggacagcctgatccgcgccgccgcacccggcagcgcggggggcggtgccggacggaatgcggcggcccgcgataccacctttctcgaccggctgaaggcgattccggccgcccggccccagatcaccgtgatcgaaggcggtcgtggtgcgccggccgccgcccagccgctgtcggcgaagaatgcgacgcctgtcgggacgacgcacccggctgcaccgcgcacgcgccagggcagcgggcacagccccgccttcgtcgcccggctggggggtgccgtcgccgcggccgccctggtgatggggctgctgatcggcggcaatggctgggtctcgaccccggcgctggcgctggacggcgccgagatcgatcttgccgccgtgctctatggcgaacagggcagcctggaggaagcgccatgacgatgaccggacgccgggcccgctgggtggtgggcgggctgatcgccagcctggcgctgaacctgttcgtggccggcatcttcctgtcgggcgtgctgatgcggcccggcggacacgaccgcggcatccaccgcctgctccacgacatgcccgagccgcagcgcgatgcggtgaagacggccttcgaagcccgcaggcccgagcttcggcagcggctgatggcgctcaaggatgcgcgcggcgagttgaaggccgtgatccgtgccaccccgatggcgagccccgaggccctggaagaggcccttgcccgcgtcgccgcccgtgatcgcgagatgcaggatctcacctccgacctggtggtcgaaggctggcgccgtgccgcggccgggccgcgctgatccccatccggtccccctacaacgcaatacgcccgctccggttccccggggcgggcgctggtcttaagccctgcgttcgggtggaacgccgtcagcctgccgtgagcagatccctgtggatggtcgcgaaatcctggatcgacaccgggcggatcggcagacgggccagggcggcttcgtggtcgacatgggtggtcatcatgtccgggctctcgaagatcccgcggtaatagccgatgatcgcttcctcattgccgtcgaacgagatcgcccgggcgaactcctcgggcggcatcggccggaaggtgatctgccggcccagcgcacggccgaagcgttcggcgatctcggaccccgacagcttctcggggccggcgatctcgatcaccagcgtctccggatccggatcggcgaaggccgcgacggcataggacgctgcgtccagatggctgatccactggcaccgcaccgcctcgggcatcggataggccagcacatcggccgtcgccacctcttgtgcgattgccgggatcaggaaattctccatatagaccgtcggctgcagggcgacgaaagagataccgctcgcctccagcgcggccaggatgccgcgccgcatgtcgatcgacgggttgccggtgtcgaagggcaggatcggcccggtggcgttccagacgatccggcggacgccctgatccatggccgcagcgatcaccgtctccgcctgggctgcccggccagcgaagaacgagatcagcagaaacaccccatcctggcccaccatggcggccttgacggcagcggcatcctcaagatcgcccgcggccaggcgcacgccgatgtcggccagaccggcggcgcgggccggatcgcgcaccagcgccgtgacttcgtagccggcggcagccagcttctgggcaaccgggcgcccctgggggccggttgccccgatgaccagaattttcttcatgggccgtctccattgaattgatatagtgaaaatcgtcgagtacgtcgtaaatcacaagtagacttgttttcagaacatagtcatatttttatgaccatggagacgaacatgacatcaaagacggacgaatcttgtcttcctggtgaaaactgcccggtcacccgggccgtccgcgccctggatggcaagtggaaattgcacatcgtcttccatcttctggatggcacgaagcggttcagcgaattgcggcgggccatccccggcgtcactcagcagatgctgaccagccagcttcgcgagctggaggccagtggcatcgtcgaccgccgggtctatgcccaggtaccgcccaaggtggaatattccctcacaccactcggcgccgggctgcgggcggtcactgatgcattgggcagctggggccggaatctgccggaggatcgcaggcccaccgattgacgggggccccaaaagcgacaccgcccgccccggggctccgggacgggcggtgtcgatcgtcaggcacacaaccaccggcttcataaccggcgggtggtcactccgcggcggcggcagcccgggcggcacggccctcgacgcgcaccaggtcggaataggcgtgcagcagggtcgagcaggcctcggccggcttgaagctgtaatcgccgatctgccggaccggggtcacctcggcggccgaaccggtcaggaagcactcgtcgaacccggccatctcttccgggcggatatggcgctcgacgatggtatagcccgcctcgcgtgccagacccatcaccgtgcggcgggtgatgccgtccaggaagcagtccggggtcggggtgtgcagttccttgccgcggccgaagaagatgttcgcaccggtcgcctcggcgacatagccgcgataatccagcatcagcgcatcgtcgaagccgcgaccatccgcctcgcggcggctcatggtgcagatcatgtaaaggccggcggccttgctctcggtcggtgcggtatcgggcgccggacgcttccagcgcgagatctccagccggatgcccttcagcttctcttcgggcgagaagtaggacggccattcccagcaggcgatggccatgtggaccttcgagccgcgggtatagacgcccatctgctcgctgcccagccaggccaccgggcggacataggcgtcggagaggccgttggccgccagaagttccgcagttgcggcattcacttcggccggcgtatacggcagctcgaagccgagcagttgtgccgaacgggcaagccgctcagaatgctcgttgagcttgaaaaccacaccgtcatacgccctctggccttcgaacacgcagctcgcatagtgaaggccgtggttgagcacgtggatgcgtgcctcgcgccacggggtgagcttgccgtcgaaccagacccagccgtcgcggtcgtcgaaggggatgagtgccattgtcgcgcgccttggctaatttgcgaacaaaaactggatgggatgagtaacattccgttccaactatgtcaacatggctgccgtaatgtccaatccgaacgcaaatccgaatccgctcttcctccgcgaggaggagctgaaccagggcatcgaactgctgttctacggctatcgcgacttcaccgccgagccggaccgcatcctggaaaagcacggcctgggccgcgcgcatcaccgggcgatctatttcgtgggtcgcaatcccgggacgactattacagaattgttgcgcatcctgcgcatcacaaaacagtccctgagccgggttctgaagcagttgatcgatcaggggctgatcgatcagcaatcggggctccgtgatcgtcgacagagacttctgtatctgaccgagaccggcaaggctctggaacgcgaactctcgggaaatcagcgcaagcgcatggcccgcgcctatcgtgaggctggggccgaagcggtcgaagggtttcgcaaagtgatgctgggcgtgatggacgatcccgaacgcgacgggttcaaccggccatgagcgatcaggacagccggggcaggccgcctgaggcctgcggcgccggatcggctgccatgcagccggcgcagggcgcagccgtgccgcccgaccccgacgcgccccatatcctggtggtggacgacgaccgccggctgtgcgggctcctcgcccggttgctgcgggaaagcggcttcatggtctccaccgcccatgacgccgccgaagcccgcgccaagcttgccatgttgaccgtcgatctgctggtgctggacgtaatgatgccgggcgaaagcgggctggacctcacccaggcgctgcgccgcgacggcgatctgccgatcctgctgctgaccgccatggacggagcagaagatcgcattgcagggctggagaccggggccgacgactatctgaccaagccgttcgagccgcgagagctgctggcccgggtgaaatcgatcctccgccgatcggtgccgcgggcggcggcggccgcaccggcattcgccggcggccttcagggggtgacgctgcgtttcggcccctggagcttcgacctcggccgccaggaactgcgccgccatggggagatcgtgcatctgacccagggtgaggccacgctgctgggcgtgctggcggccgcccccaaccgcccgatcagccgcgacgaactggcagaccgggcccagatccgcggcggcgaccgggcggtggacgtgcagatcgtgcggctgcgccgcaagatcgaagacgacccgcgcaatccgcgccatatccacaccctgcgcggcgccggctatgcgctgcgcaccgacggctgatccgcccccggagatcctgcgtgacccctgtcgaccgcatcctgaggaccatcctgccccgctctctctacgggcggtcctttctgatgatcgtggcgccgctggtggtgctgctcggcctgtcgacctatctgttctacaaccgccactgggacaacgtcacccggcacatgaccctggcggtcgcgggcgacatcgcgctgacggtggaggtgctgcgcaactatcccgagggcgaggaacgcgatcgcctgctgcgtctgatccaggtctataccgatatccgcttcgatttccggccgggggaaatcctgcccaatgccggccggcggacggtgaacaccctgctggagcggatgatgacctcggcgctcgacagccgggtctaccggcccttcgtactggatgcggtttcggacgagaactgggtgatcatcgacgtgcagctgcaggacggggtgctgggggtgaaggtcccccgcaagcgcgtgaccagcgccacgacctacatcttcatcatgtggctgatcggcatttcgctgacgctgatgatcgtggccatgatcttcctgcgcaaccagatgcgatccctgcgccggctcgcctcggcagccgacaatctgggcaagggccgcgacgatctggcagggttcaaaccctcgggcgcgaccgaggtgcggcaggtagcccatgccttcatccgcatgcgcgaccgcatccaccggcaggtaaaccagcgcaccgagatgctggcgggggtcagtcacgacctgcgcaccccgctcacccgcatgaagctgcagctggccctgatgccgccctcgcccgatgtcgcggagcttgaggcggatgtcgaagagatgacccgcatggtcgagggttatctggccttcgcccgcggcgagggcgccgaagagccggcggttctggccgatctggcccagctggtgcaacaggtggtgttccgtgcccgcggcctgtcggacgcgcggatcgacctgaagggcgccgatcacgccatggtcctggtccggacccaggccttccgccgctgcctgggcaatgtgatcgacaatgccatccgccatgccgaccgggtggaggtgaccattctgcccgggcgccagtcgatccaggtgctgatcgatgatgatggcccgggcattccggccgatctgcgcgtcgaagccttccgtcccttccggcgactcgacgataccgggcccgtggccgaggccggaaccggcctcgcctcgggcattaccggtgtcgggctcggcctcgccatcgcccgcgacgtgatgcgcggtcatggcggcgatatccggctggaagacagcccgctcggcgggctcagggtcgtgctcgacctgccggtctgatccttacttacggacccaggtctcggtgcccttggaccccttgtccttgtagcgccaccagcgggtgacgatcgacccgtcgggccggatggtgccgatcgagatgctgttcttgccatcggccatcgaggcgaacgagaaggtatcgccggtgacctggccgacgccggtataggcgccgccgtcatagacgatctcataagcgcccgacgcggccttggtcacgaccacctcgccggcgccgtcataggcgctgccgtcggtgtcggtgccggtataggtgtagcggccggcgatggagctttcggcccgggcggcggaatacggcccgggggcggtgagggtaagggcaatcatcgtgcccaatgcgaggctgcgaagcatggaagacctcgggtgctgacaagaccggctctgcggccggccgaggtcagtatccgttcggccccgggcgtctgacgcaggccagccgccgctcggtaaaccgcggtttatggtcggcgatgctcaggccggcgctaccctctcgtcttcgcgcacgacacgatcacgcccgctttccttcgcggcgtaaagactgtgatcggcgcgcagcaaagcgtcttcgaaatcatagccggcgcggatcgaggcgatgccgatgctcaccgtcacagtagtccgttccagcccggggatcacacgtccgcaattggcgacgccgcggcgcacccgctcggcgatctcggcggcccgccgcccttcggcgccgtgcagcaggacggcaaattcctcgccccccagccgggcggcgatgccggcctcgcccaccaccgtccggatgatcgcccccaactccttcagcacggcgtcgccggtggcatggccgaaatcgtcgttcaccgccttgaaatggtcgacatcgatgaacaggatcgccccctgatcgcgggcggcgacctgttccgccaccagccgccgggcctcggcgaagaaggtccgccggttgaacagaccggtcaggtcgtcgatcttcgacaaccggtccagttccagcgccatctcgcgcagtttgacattctggccgatgaagaagaaaccaagaggatagccgacgatcagtacgatgatcgtggtcagcacgatgtccagcggcagacgatcgaattcaaaataccagtagaagaaggccgtcagcagatccgccccggccaccgcgacgcagatcatcagcgtcacctgccggaagaccgacatcgaactcagcttatgggtccaggacccggccttgatctgcatgcgctgccccttcctctgcgtccaggacatacaccggacgcgtcatcaggaaaagcgcagaaccgtgacgatgcgacaggttcaactcaggcgggcgccgtccggcacgtcatgatccggggcgatcaggctgatccgcccctcggcatcggcgaagcccagcaccagcacctccgacatgaagcggccgatctgccggggcgggaagttcaccaccgcggcgaccttgcggccgaccagcgtttcgggtgtgtagagatgggtgatctgggccgaactccgcttctcgccgatcttgggcccgaaatcgatccacagcttgatcgccggcttgcgggcctcgggatagggctcggcgcgcaacacggttccggcacggatatcgaccttcagaaaatcgtcgaagccgatctgagaggcagggctggcatcggtcatgggttcgcgacctcggcggacatcgaagatgtcgccatcctgccccggaacggccgaagggcgccacccccttgcgggagcggcgcccttcgaaacctgtcggtgaccagaccgggcggcgatgcgcccggcgccggatcacttcacgacggcgagggtcttcacctcgtcgacgctctcgatgaagcgcttgttgaggacgtcgaacgcctcaccctgcgacttcgtcgccagctcggtcagctcgcgggcgttggcaacggccttctcgaccgcggccttcacgacctcggcctgcttctcggccttcgcctcgacggtgccggcgttcatgacttcctgggtggccttccaggcgtcctcgaacgaggcgcgggcaacttcggcctggcgcttggccagggcctggaagccctcggcgatcagcttgttcgcctgggcaaccgcttcgtagttgcggcgggcggtgctcatcatcgcctcgacgtcgacggccggaaccgccggcatcttgaactcgccgaacatcttggtgtagtcgagggggttgatcttctcggccatttcaaaacctccgttcgcctttgcgaccgatggcatggcttggcatcaggtcgctcgcggcgcagcgtcggggtttatgctgcgctgcaaaatcctcagccatatatgcggcatcggacccggaaggtcaagggcggtttttgcgttgcacaaaaatgtcggcgcgatgacggatgcaggcgatcccgcttttcggttgcgtggaaatcgtcggggtcgtcatcccgcagcgggcgtgtcggcggccggagagggccccgcggatggctcggctccggagcggaacccacgccgcccgccggccatccggccggccatgcgtgaccagcgcccggcccggtcgagcaatcggtcgagcgtcttcatggtcttcgcccggtcctcgctgtcgtccttcagccaggcccgcagcgtggcgagatagatcgcagccaacccctgacggcgggccagcccggcgatgccgcgggattcgagcccggccgcagcagcgagccatcccatgctgcgttgcaggcgcatcccctgcccgcagatcagatccagcgcgggaatgccgcggtcggaccggtcggccaggcgctgcatcaccgcccggtgcggctccagcgcatcgagccgcgccatgatcagtgccatcagccggtccttcaccggctgggcggcgaactcttcgggttcatcctcggcctcggtcaacatggcgcgatcgattcggcgcgagaaggcgtccaggatctcggagacggagccgacatgccccgacaattcggacagcgacatccccgcctcttcggcgatgccggccagcgtcagcccgtcccagccgtcgatggcggcacgggcgagggctgcgtcgatgatccgggcctcggcgtccttgaccttgggcatggggcgtcctcctgggttgatggacgagggcggaactgcctctgttcaaacatagttgatgcggcggtccataccagatcgaaagcctgtgagaaattcggaccattccggtgcggattggcgttcccaccggacacgggatatggaatcctgtacattcacgatgttgcgaaggccatgagagtctggagggacgtcatgatcgaccggctgaccaggaatgtccgtgccgcgggtcgcagccaggatcgcggcgacacccgctatttctcggccgtccagcgccagcccctgctgacccgcgaggaagaggccgatctggccatgcgggtgaaggccggtgaccgcgaggctgccgatattctggtccgcagccatctgcgcctggtgatcaaggtcgcctcgcgctaccgcaattacggcctgccgatgaacgagctggtccaggaaggctccatcgggctgatgcaggcggtggagcggttcgatcccgaacgcggggtccggctcgccacctatgccatgtggtggatcaaggccgcgatccaggactatatcctgcggtcctggtcgatggtgcgcatcggcaccaccgccgcccagaaggcgctgttcttcaatctccgcaagctgaaggcccgcctgcggcgcagcgacgaaacccgcgcctcggaaagcctggatccgaccgatgtcggccagatcgccaccacgctgggtgtgcgcgaccgcgatgtgcggatgatggagatgcggctttcgggcggcgaccagtcgctgaacgcgccgatgtcggctgacagcggcgatgaatggctggatcagctggccgacgacaagcccgaccaggaggaacagctggtcgaacgtgatctggcctcgttccgcaagcgcatcgtccgcggcgcgctggatgccctgaatgcccgcgaacggttgatcatcacccgccgtcatctggccgaggcctcggcgacgctggatgcgctgggctcggaactcggcatctcgaaagagcgggtgcgccagatcgaaagccgggcgatgcgcaagctggccgatctggtggagccgcagctgcgcaaggccctgggtcgctccggcagcccggcctgatacggcccgatccgacacggcatcgaaagagggggcagccgccccctcttctgctgtcggtcccgcctatctcagcgccgccgcgatgttgccgccgtcgaccgtggtgaccgagccggtggtcttctgcgccagcgccagatccacgaaagcctgggcgacatcggccgcggtcacctcgcgccccagcaggttgccgcccatgtaatccgcctcgctgaggccgcgggccttcgagcgcgcagccaccatctcgtcggtcagcagccccgagcggacccgatcggcattcaccgcattggcgcggatgccgtcgcggccgtggtcgagcgcatattgccgcgacaggaacagcgtcgccgccttgggcaggccataggggccgaaatcggggcccggattgaccgcctgtttcgaggcgttgaacagcagctggccgccgaagccctgggctttcatcaccttcaccgccgcctgggcgacgcgctgatggccgtagaaattcagctcgaagctctggcgcagcaccgcctcgtccacttcgccgatccggccctgccaggcggcgccggcattgctgaccaggatgtcgagcccgccgaagcgtgtcaccaccgcctcgatcgcggcagtcaccgaggccgggtcggtcacgtcgcaggcgatgccgataccgcccagcggcctggccaccccggctgccgcctcggggttcagatccagcaccgccacctcggcaccggcggtggcaaaggcccgggcggtggccgcaccgatcccccctgccccgccggtgacggcgacgatccggcgctgcagcggcttctcgccgcccttgcccagcttcgcctgttccagcgaccagtattccacatcgaagagatcggcttcggaaatgctctcgaagcggccgatgccctcggcaccggtgatcacctcgatcgcggcctcgtagacatcggccgcaatccgcgcctctttcgacgacttgccgagcgcgaagatgccgagccccttcaccgccacgatccgcggcatggggtcgagttcggtcttgatgccgccgagccgttcgttgttgcgggcgaaataggcgtgataggcctcgacatagcgaccgagcgccgcctctgccgccgccctgaagcccgcgaggtcatccgccctgggggccggcaggatcagcggcgccggtttggtgcggatcacatgatccggcgtcgcgacgcccgaattggcgatccggtccagatcggcggcgttgacaaaatccatcaccgccgggccggcgcgatgctccagaacgaaaggccgacgcccgccctcggcggcagggtcggccagcgccgtcaggccgcgcagcaccggcgccaccgcggcgaccggcgccagccccgccggaacggccgcctggaccagcgtccgccggccgcgggtcagccgttcttcggccatcgacacgaaatcgatcatcagctcataggcggtgcggccgtcatcgtcgaagctgaaaatgccgtgcttcagcagcaccatgcccttgacgcccggcgtctcacgaacgatgcgggccgcggtcctggccagcaggaagcccggcatgatgtaggggatataggcgacccggtcgccatacagctcgcggacgatcgcctcgccatccggctggtcggtcagcgacagcaccgcattggcatgggtgtggtcgatgaatttctgcggcaggaaggcatggagcagggtctcgaccgaggggttgggagcggtcgagtccagcaggttcagccgctggacattgaccatctcttcgtcggtcagcgcctccagccgctccagctggcgcagcggctccagccgcaccgccggcaggcctgcgggttcgatcacccccatatcccagccgctgcccttcacgcacagcacgtccagcggatcgcccaggatgtcggtcatccgggtcttgaccgaggtgttgcctccgccatgcagcaccagccgcggatcggagccgagcagccgggtggtatagaccctgagcgccagatcctcgttcacaccctgatcgacatagcgggcgaccatggcggccgcatcggcatcggaccagcggttctgcatcgtcttcacctcagcttcaattcgcagacaggccgggtcgggtgcgcggtcactcggccgcggcacgctcgggataaaggccgcgcagcccctcggccgaagcggcacagacgccgcgttcggtgatcagcccggtgaccagccggcccggagtcacgtcgaaggccgggttggcggcggggctgtcctcgatcaccgtcacatcggcgatgccgccatcgggcagccgcccgcgcaccaccgtcacttcggtcgccgaccgttcctcgatcgggatgtcgcgcacgccgtcggcgatccgccagtcgatggtcggatagggcagcgccacatagaacggcacgccgttgtcatgggcggccagcgccttcagataggtgccgatcttattgcagacatcgccattggcggcgacccggtcggtgccgacgatgcacatgtcgacccggccgtgctgcatcagatgcccgccggcattgtcggcgatcacggtatggggcacgccggcccagcgcatctcccaggcggtcagataggcgccctggctgcgcggccgggtctcgtccacccagacatgcacgggaatgccgcgagcatgggccaggaagatgccggccagcgccgtgccccagcccaccgtcgccaggaagccggcattgcaatgggtcaggatctccaccggccggctgcggccgatcgcctcgtaacgcgcctcgatcagccggaaggcgttctcgccgatcgcccggttgatcgccacatcttcgtcagaaatctcccgcgcgcgggcataggccgcatcggcccgcgccgcttccggcagcggcgccacccgttcgcgcagatcatccagcgcccagcgcaggttgatcgccgtcggccgggtcgcgaacagccggtcataggcggtggcgatcatggcatccgacgggtcttccgccagcgccagcgccatgccgtaggcgcccaccgcaccgatcagcggcgcgccgcggaccagcatgtcgcggatggcggtttcggcatcgctcaggctggtcagccggacgtccacggtctcgaagggcagccgggtctggtccaggatgccgacggtccgcccgtcggcttccagccagacggtgcggcgggtgaaacggctctcgtccatggggcggggctccggatctctgtgggcggatcaggcgccgagcacgcggccggcgacggcgtcgagccgggcgagcagctcgggatcgcgcttctcgggcgcggtgatcagggcatgatcgagtgccgtgtggcagccggcatggcagggctcgcgacggtcggccagcgcgggcgccacctctttcaccagggcgcgggcatgatcggcattgcccagaagcaccttcaccacctgctccaccgtcaccttgtcgtgctcgggatgccagcagtcgaaatcggtcaccatggcgacggtcgcgtagcacagctccgcctctcgggcgagcttggcctcgggcatgttggtcatgccgatcacgctggcgccccagctgcgatagagcttcgattcggcaagcgtcgagaattgcgggccttccatggcgatatacgtgccgccgcggcggatatcgagaccgagccgctggcccgccgcctccaccgcatcgcccagacgccgacagaccggatgggccatggagacatgggcgacgcagcctttggtgaagaagctcttctcgcgggcaaaggtgcggtcgatgaaatcgtcgacgatgacgaaggtgccgggcggcagatcctctttcagcgagccgaccgccgagaccgacaggatctcggtcacgcccgcccgtttcatcgcatcgacattggcacggtagttgaggtcggacggcgcatggacatggccgcggccatggcgcggcaggaagaccagctgcacatcgcccagccggccgaacatcaactcgtccgaaggggccccgaagggcgaggagatccgccgccagccgatatcggtcaggcccggaatgtcgtagacgccgctgccgccgatgatgccgatcaccgggcggccgtcgctgcccaatccgatgcctgcgcccgctgcactggtcgatgccatgcccgtcacccctcgtctggttcgtctcgtcatccggccccggatccatccgcgggccctgctcttcccggctgctcgcattctgcgtggttcgggaggaattttctaccctgcgttaagcgccggccaccggcttcccgcgggacggcgccggttgcgacaccggccgggacggcgcaccctggccgacccgtggccggaatgcaacaacccgaaacgcaacaggggcccgaaacgcaacaggggcccgaaacgcaacaggggcccgaaacgcaacgggggccgcccctccgcaaaagggcgacccccgtttcgatccggtcggatcagccaggctgcatcaatggatgcgggcccagatccgccgcttggcaacatagaacacgatggtcagcgcaatcaggaacaggatcaccttgatgccggtctgcttgcgctcttccatcttcggctccgcgagccaggtcaggaagaccgacacgtcgtgagtcatctgttccacggtcgcgggcgtgccgtcgccatagggcaccatgtcggctgccagcggcggcggcataccgatctggtggcccgcgaagtaggcgttgtagtacatgccgggccgcacttccatgcccgccggcggctcggtatagccggtcagcagcgcatagatgtagtgctcgccacccagacgggccttcgccatcagcgacaggtccggcggataggcgccgccattggaggcgcgggcctgcttctcgttggcataggggctgggccagcgatccgaggcgacggccgggcgcatgaacatgtcgccattgtcgtccgggccgtcctggacctgcttcttcgccgcaatcgccttgatctcgtcctcgttgtagccgaggtcggcaaggttgcggaatgccagatacttggccgaatggcaggccgagcagacctgttcgaagacctggaagccgcgctgcgccgctgcgcggtcataggtgccgaacgggccctcgtggctgaacgagacctcgggcagttcgaccgcttcggcagcgatcgcggtggcctggacgcccatcagggcgccgaggccggcgagggtgctgatcaggagcttacgcatcacgccttctccatcgcgcggtcaccgagcacggcagaggcgatgctctcgggcagcggccgaggccgttcgaaccagccgagcagcggcagcagcaccaggaagtgcaggaagtaccaggccgttgcgatctggccgatgaccaccgccacaccttccgccggctgaccacccgcccagccgagcgccaggatgtcgatcatcagcagcaggtagaacaccttgaacaccggacggaacttcgcactgcggacccgcgaggtatccagccagggcagcaggaacagcacgaagatcgcggcgaacatcagcagcacgccgccgagcttgctcgggaccgaacgcaggatcgcgtagaacggcaggaagtaccattccggcacgatatgcgccggcgtcaccagcgggttggccgggatgtagttgtccggctcgccgaagaaattcggtgcaaagaacaggaagacggcgaagaaggtcaggaacacacccagcccgaacagatccttgatcgtgtaatacgggtggaagggaataacgtccttcttggtcttcttgtcgatgcccagcgggttgttggagccgtgcgtgtgcagcgccgccagatgcagaaccaccacgccgacgatcacgaagggcagcaggtaatgcaggctgaagaagcggttcagcgtggggttgtcgaccgagaagccgccccagagccaggtcacgatgctctcacccaccaatggtatggccgagaacaggttggtgatcacggtagcaccccagaagctcatctgaccccagggcagcacatagcccatgaaggcggtcgccatcatgagcagcaggatgatcacgcccagccaccacagaatctcacgcggggccttgtaggagccgtaatacaggccgcggaagatgtggatgtagacgatgatgaagaacatcgacgcgccgttggcatgcgcatagcgcagcagccagccgaaattcacgtcgcgcatgatgcgctcgacgctgtcgaaggcgagcgacgtgtgcgcggtataggccatggccagcacgatgccggtcacgatctgcaggaccagcgcgatgcccgccagcgaaccgaagttccaccagtaattcagattccgcggcgccgggtactcgatcaagtgttcccgcgcgaaggagatgatcggcaaacggtggtcgatccagttcgacacacggctgccggtcgagggactgctcatcgcctaaccccaaccctgttcttggttttacccgatgcggatggtgttgtcgtccacgaatacatattcggggacggcgaggttcgcgggtgccggacccttgcggatgcggcccgaggtgtcgtaatgcgaaccatggcacgggcagaaccagccgtcgtaatcgccctggtagcccagcgggacgcagcccagatgggtgcagacgccgacgaccaccagccattccggcttttcgacgcgatccgcatcgggctgcggatcgggcaggtcggccacattgaccgcccgggcctcctcgatctccttctcggtccggtgacggatgaacaccggcttgccgcgccaggtgatggtcaccgcctgaccggcctcgatctgggagatgttcacttcagtggacgacaacgccagaacgtccgccgccggattcatgctgtcgatcagcggccaggccagtgccgcggcacccaccgcagcgccgccgcccgccagcagcatcaggaagtcgcggcgcgtggcatcgtcaccatggtcgtggtggccgtcgccggatggcaccgtgttcgccatttcgcaaacctttcgtcgctctcacaccttatcgggcgtaaagcctcggtctcgcctgcggtcgcacgggatccggccgaacaccgctcactccgtccccgccgtttccccgttcccggggatccgccgatatacacggatactgtccgcggcacccggactggtggatgcgtcaggttgtcgcaccaccatagggtggccttgcgaagccccgacgtcgttccttttcctcccgtcgatcacggccactcgtccaacgcccgaagcgaggcaccacctcttgcccgaacgggtggattactgccgtgtcgcaaaggggtataccgaaaaaacgccctctttgcaaaggatgcccccctgggcatgttacagacgcccgggcgatccgtcgcccgtcatcggtgtcccgccccgatatttccgccgagcgcggcaagagagacacgtctccttcacccggagcccgccatgcgcctcgccctgtacgaaccggacatccccggaaatgccggaacctgcataaggctctgcgcgtgcctggggatcggtatcgacatcatcgagccctgcggttttattctgtcggatgcgcgcatgaagcgggcggggatggactatgccctgcgtgcgacgatccgtcgccatgccgactggtcggcgttccgggcgacgcgcgccgccgaggtgcccggcagccgtctggtgctggccaccacccagggcgcggtgccgcataccgacttcgccttccgaccggacgacgtgctgctgatgggcagcgaaagcgccggcgtacccgaaagcgttcatgatgcagtcgatgcccgggtgcggatcgcgatggtgcccggcatgcgatcgctgaatgtcgccgtggccgcatccatgatattgggagaggcactgcgccagaccggtggatttccggcagagccggtcgcctgcccgccccagccagtcctccccgaggagaccagccgatgagtttcgacgcccgcgccgtgctcgacgcccgcgcccgcaccagcccgcccgaggatccggaggtcgcggccgaacgccgccaggccgcatcgggctggttccgcgagctgcgcgaccggctctgcgcggcgttcgaggcgatcgaagacgattatgccggaccgatgaacccggatctcgcccccggccggttcgagcgcacggcgtgggaacggccgggcggcggcggcggcgagatgtcggtgatgcgcggccgggtgttcgaaaaggtcggcgtgaacatctcggtcgtccatggcggcttctcgcccgaattcgcaaagcagatccccggcgccgaccgcgacccggcccccggcggtgccgatggcgccggcgcgcagttctgggcggccggcgtgtcgctggtggcgcatatgtggtcgccgcatgtgccggccgcccatatgaacacccgccatatccgcaccacgctcggctggttcggcggcggcggcgacctgaccccgatcaccccgcacgcccccgataccgcgcgcttccacggggcgttcaaggccgcctgcgacgcccatgacgccgattactatccgcgcttcaaggcctggtgcgacgactatttcttcctgccccatcgcggcgagacccgcggcgtgggcggcattttctacgactatctggacagcggcgactgggcgcgcgacttcgccttcacccgcgatgtcgggctcgccttcctggatgcctatcctgcgatcatccgggcccatatgaaccgatcctggaccgaggccgagcgcgactatcagttgatccgccgcggccgctatgccgaattcaacctgctctacgaccggggcacccagttcggcctgaagaccggcggcaacaccgaggcgatcctgatgtccatgccaccgcatgcgaaatggccctgaggcccaacgcgctcacctggcccgacgcactcccccggcccgacgcactcccccggcccgacgcgctcagctttccgccccgcgcctgaccgcccagaccgccagcacgaccagtgctgcggcacccgccaccatgggcaggccgtgcatcgacagcatttcggtggcaaggcccgcggcggccgggccggcgaaaccgcccagcgtgtagcagaaggcgatcgcggtcatggccgcactcatccgcatctcgtcgacccgggcgccggcctcgatcaccgccagggtgttcaacccgccgaccgcgccgccccacaggaaggcgatcacccagggcaggattgcgtcatcggccagcggcagcaggatcgcccccaggatgacggccgtcgccgccagtgcctgggcccggtcgaagcccagccggtcggcgatggcgccgagcgggatctgcaggatggtgccgccggcgccgaaagccgtcgcgaagagcggggccgccaccgcccccactgccggccgccgcggcgtaaagcggcaggaaggcgatggaggcggtctcggccacgccgcaggcgaaggctgcggtcagcgccaccggcagcagccgcaccagcccccagcccgatcgccggccggcgccgtcgcggacgggcgcgacgcccggccggccgtcgaagcccagccgtttcaacaccaccagcggcgggatcgccgccgccatcaccgcggccgccgccaggaatggcaggctgccctcatgccccgtcagcgccaccagcccggggccgagcgcgatgcccaggcccatcagggtttcatgggtgccgatggcacgaccgcggatcgcctctggcgcgatgcgcacgatccaggtgtcgcaggcgatccagcgcaggatcagcccgatgccggcaagcgcgttcaaccccgcgagggcgatcggatcttccaccaccgccatgccgcccagcgccgcgatgccggtgatcagcgccagcgccaccgtccccgccagccccagccgggcgatgatcgccggcacgaagcgcgagaccagcagaatcattgcccagggtgcggcggccacaagaccgatggtgccggcatcgacgccgcgcccgtcgagcatcagcgccagcaacggtgcggtcgccccgatctggacgatctgggcgagccctgacagcaggttgaccgccacgagccccacgagaacccgggaggggtggcggtcatcggggcgggaggcggccgccgaagggtcggaattggtcgatgaggcggtcattggggggagacctcggatgggaagcgccctgcagccggtagatgtatcacgttgcgatcatcaacttataattatgattccgatctacattctattatagatagatgaattcgcatcccggatccacgaccgaaatggttcgtcccatgatcccctcatcccccgccgaagaagcatcgcgagacgatgcgctcgagaggctgcgcgactggatggtcagtggccttggctgtgtcgccggccgccgcgagttcctccgcaaccgctattacatcgccccggtcgcgacccccgacgacgtgcgccgcgccttcacgggtttcgtggaagccctggaggcgcgccgcacggtcgccgggctgttcgtggccacccgccccgatggcggcatgctgccgccggaaccggtcgccaccgccatccggcgcatggccgatctgatgtcggtgctgaccacccgcccgcccgaagtcctggtcgatggcggccagctgaaccgcgcgatcgagctgacctgcccggtcaccaaccggcggctgctcttcgacgatttcgatgccgtcgccttctgcccggccgccgccgacccgggcgatccgctctacgacccgatgatggcggcgcccgtgatctgcgccaacctcaattccgacgtctatgccttttcgatgttcacccgcgatctctgcctgcaggcccatgactgcgaggtgttcgagattgcggatcaccgcacccgccgggccctgttcgcccgggcctcggagctgtggcagcgctttgccgagcgcacggtgcggaactatgtctcgatcaccgacaccggcctctgccccacctatctggataccgatcgtcaccactggtatgccagccatcaggatccggccttcgccgagatgcgcaaggagctgtaccgccacgacatgccggtgctctataccggccgtatcctccggcgctggatcgcctggttcgaggggggcgatgcggcggccgaagcgcatttcgaaccctcggccctcacccccgccggctgcccggtgcatgatggcggcggcgcctgaaccggcgccttaccggctcaaccgccgcccccgcccgtgctgctacccatgggcacgaagcggcgccgcgcctcggcaaggcaggcgccgcgatcgggggcgaagccctcgtccagccaccaggcctcgatctcggacagcgcctgccccaacccggggccgggcttcaggccaagcgcgatcagatcggcgccgcccagcggcagatgcggctggctccagcccgacagcgccccgatcgcgcggcggaagccggcctcgtcggtcgcatcgagcacgccgcgggcgcgggcgcgcgcccagccggcgaacagccggtcgcggatggtggtgatgccctcgcgataggcggcgacccgcaccgtcaaggggctgggcggtctggccggcaggcgggcggtcgcctcggccaccgcccccacccgggccaccagctggttcgacggtttcagccgctcgatccgccggcgccagtggtcgacggccccgaaggccggcccgcaggtggccgtcagcaccgccagccggcgggcggcatcggccatgtccagcgcctcttcgatcgcgatcagcgcgtccaggggccccgtgtcgacgatcccgcccagcacctggtcgagcacgcccagatcggccatcagcagcaggatgccgtcaccgccggccacgcgcggcccgcccagaatccgcaggaattcctcgcggatccgctcgcccgacagcgcctggatgcgctcggcgaattcccggcaggcatcgacggccgcccggtcgggctcgccgcggcccagccgcgcctgaaaccggaagaagcgcaggatccgcaggatgtcttccaggatccgccgccgggcatcgccgatgaaccgcacccgcccggccgccagatccgacagcccgtcgaagggatcgtagagccggccggcaaggtccagcgacatggcattgacggtgaagtcgcgccgccgggcatcctcggcccagtcgcgactgaaggccaccaccgcccgccgcccgtcggtggcaacgtcgcggcgcaaggtcgtcacctcgaccggcagacggtcggcgatcagcgtaacggtcccgtgctcgatgccggtcggcaccgccttgatcccggcggcggcggccgccgccatcaccgccggcggctccagggtcgtggccacgtcgatgtcgccgatggggtcgcccgagatcaggtcgcggacggcgccgcccacgaagcgcgcctcgccgcccgcggccgcgagcgccgcgaagacccggcgcacgggtgcagccgccatttcgggcggcagcacgacatcggttcggacgggatcggtgcgcgcaggcagaaggggttcgggggcgtcggccatgatgcgggatcacgctggagcaggggacggtaaggcgacgatgggcgcggtcagtcctgcccgtaatggcccgggacgatccggccgtcctccaccctgggtggaacatagacgcccgggtcgggccggggaccgaccgcatgccccaccaggaacaatgccgccgccagcaccaccaccgcaagcccggtgacccagaccggcggtgcgtcaggccggctgccccgctgccgctccacccgcccggcccaggccatccaggcggcataggcaaggaagggggcaaggaagggcaggatataggtcagcaggatccgcatcgccctgccctagcccgccccggccgcgatggtgccggcggcggcgaaatcggcgaccctggggccggccatgcggccctcgccatcggtgtccttcagcgacagcccggcatccagcacccgggtcagattgaccagcatccccgcggtcgccccccagatgtagtagcgcccgaagggaaaggcataccagtgacgcaccaccccgccgcgttccagcgagtgacgcttgcggttgcgcgggtccatgaagaaggcgagcggcacctcgaagacgtcggcgacctcgaaaggatcggggatcacctcgaagggcggcgtcaccaggcccacgatcggcaccacatggaagccggtgatggtttcgtaggtgtcaagccggccgatgatccggatgtgatcgcgggtgacgccgatctcttcccgggtctcgcgaagggcggtgtccaccgcatcgacatcgccctcgtccacccggccgccgggaaaggcgacctggcccgcatgggcatgcagatgctgggtgcgctgggtcagcagcacggtcagccccccggaccgttccaccagcggcaccagcacggccgccggccgcttggcgccgccatggcgggagccggggttgagcacatagtcgccgttcaccgccggcatcgccgggtcgatgccggccgcattgggctcgttgaacagggcggcgatatcggcaccggtggtcatgcgcggcctccggcacgatgccgcggctctgcgatctcgatatcgggggagcccagataatgggtcagaccggcacttttcaccgccagcaattcctctccggtttcgggcgaaatagccagatcggctatgttgaccagttcgtaatagacggaacggctaagcagcgcctccagcccgcggccgaccgccagatagggggcggggtcgccgctttcggggcgcgggcgcagcaccagcgggtggtcggcgtccagcggcacctcggcatcgacattggtgcggaagacgatccgggcgtcgtcgcccgcgccctcgatgcgcatggcggtcacgatataggcggcgtcctcgacctggatccggcatttctcgaccggggtctccagccagtagtcgccgtcctggtcgcggtggagcacggtcgagaacagcttcaccagcggcatccggccgatcggcgtgccctggtagaaccaggtgccgtcgcgggcgatgcgcatgtcgatatcgccgcagaaaaacggcccccggcgctgttccgccggccgggcccccggggcgggattgccgagccccagccgtccggcgaggtcggccccatccttgtcggttctgtccgcgctggtcatgcctcctcctccctggtcttgcgatcgctcagccaccgcgctctcagcgccgcgccgtggcgggccagccagcccagcgccacgagggtggtcgcattgtccagccggtcgccatccagcagggccaccgccgcctcgcgcttcagggcgaagatgcggatgtcctcgtgctcttccacaaggccgccggtcgaaccgcggtgctcggcccgcacctcgccgacatagagatgcacccattcgtcgcaggcgccgggcgagggctgataagtcgatatggcttcgatccggccaagctcaagcccggcctcttccaccgcctcgcgccgggcgaccgcctcgggcgtctcgcccggctcgatgatgccggccacgatctcgaccatccaggggctggcatcggtggggccgtagagtccgcccgggcggaactgttcgatcagaaccacctcgtcgcgcaccggatcatagggcaggaccgctgcggccgtgccgcgttcgaagatctcgcgggtgaagggctcgctccagccgccggccagaagacggtggcggagcgtcagccgcaccatgcggaaatagccctgatggaccacctcgcgcgccaggatctcgacatcctcgcggccgtaagaggcggcggcgggatcggggtcggggacaccgcggacggcgggtcggtcggcaggcatggcgctctccggtcggaacggcgggggtgtatgacgtgtcgatgacgccattctgaccccggccgccccgccggtcgagtgggcttcgtgtgtcaggcggccacggctgcacgctcgacaatggcggcggcatcgacgcccggcgccagcgtgccatagagcccgccatgatcgccggcaagccggctggcgaaccaggcctcggccaggctctggggcgtgcgctccatcagctcggcgccggccagcgccaccgccagatcgccgaccagacggcgggcgcggaactccatctcgtcattggaaccgagcgcacggagcgtggcgtccagatgggcgtcataacggctgtcctggccacgcgagcgggtcagatgcgccaccagcgcctcgcgcgccgccggctcccgcccgagggcacgcagcacgtccagcgcgatgacattgcccgatccttcccagatcgcattgaccggcacctcgcgataaagccggggcaggccgctgtcttcgacatagccgttgccgcccaggcattccatcgcctcgtagacgaagcccggcgcgcgcttgcacacccagtatttgacgatcgcagtggcgatgcgcgcgaaggccgcctcctgcggctcgctcgaccgggcttcgaaggcctgggacagacgcatcaccatgcgcatcgcggcttcctgctccagcgccagatccgccagaacattgaccatcgccggctgatcgaccagccgcttgccgaaggcctggcggtggcgggcatggtgaatggcctgggtcagcgcctgacgcatcagcccggcggagccgagcgcacagtccagccgggtgtggtggaccatctcgatgatcgtgcgcacgccgcgcccctcaggcccgaccctgaccgcccaggcaccccgggtctcgatctcggaggacgcgttggagcggttgcccagcttgtccttcagccgctggagatgaaccgcattgcggctgccgtcgggccgccggcgcggcagcaggaagcaggtcagcccggcctcggtctgggccagcgtcaggaaggcgtcggacatcggcgccgaacagaaccatttatggccggtgatctcgtagacctcctggccgtcctcgtggccgacgcggaccgcgcggctggtattggcgcggacatccgacccgccctgcttctcggtcatcgccatgcccagcgtcagaccgcgcttctctgccgccggcaggggccgcgggtcgtaatcgcgcgacagcacccccggcatccagttgcgggcaaccgccggttcggctgcgagtgccggggcgacggcaaaggtcatggtcatcgggcacatggtgccggcctcggcctggcagtgcagatagaccagcgccgaacgcgccaccatggcgccggggcggcgctcgttccaggcgaaggcatgcacccccgccccgatcccctcggccatgatcgcatgataggaggggtggaagcggacctcgtcgatccggttgccgtaacggtcgtgggtgaccagctcgggcgtgtaccggttggcatcgaagcccagcgccatcagcggcccgccggtcttcgcgccatagtcggacagatgctcgaaagcccagccgccgccgaaaccgtccaccgcgtcgaccagcgcatggtccccggtgaagagattggcctccagcggcggggcctggttgaaaacggcatgggtggcaccgggaagcggctggggcgaaccggcggccttcaggctctgatcggtcatgggggatcctccggggaaggtgatgacgatgacagagggcgtggcgtcagccgcgacccacggcctcggctgcgcggcgggcgatgcgcagcgtatcgatggtgacgtcgggccggccggtcaggccgcggcggcagaagccgacgatctcggcgatgatcatcacgtcggcctcggtcagcacgccatggccgggatcgacgatgcgggcgcgcgccagcggcccgaccagggcctcgctgaccacgccgaccatggccgcggccgcgagttccggcggctgaggggcaaggtcaccctcggccagccccgtcgccaccgcctcggcataaagcgcggtatagcgccggcgcgccgccagccgctcggtatcgaccagcggatcgaccggctcggccagaagcgcataggcgagcgcccggccggccagagcacgggcggcgaaggtggcgaccgcattggcgatccgccggtcggccggcccctggccgcggatcgcatccgccaccgccttcaactcgtgggtcgaggcccggcggaacagctcggcgcagagttcggccttggaggtgaaatggcgatagaccgtgccgaccgccacctcggcatcctcggcgaccgcgctgaccgacaggccggaaaagccggcacggcggagaatcgcgaagccggcgctgcacagcttttcccgcgttccggtgatcggtaccacgccggccgccgccgtcgacctcgccatgcctgcctcctgcggaccgccctggtgcggccgctcacgatgtgaatccggattcacatcgagccacaacccgccagacgatgcaagcggcatcaccacaggtccgggcggtccgcatcagggtgcaccgcttcgtgacatgatccgcacaccgcacctgtcccgggttagtccgcggcggccgccctgtcggccagcacaaccgggccaagagatggcgggcataattgcggcgttttgagtcggtttgaatctttcttcgcggttatgttgatgagtaaatgtatctacggtttaatatccgatgcggcctcgcatgcgacaaaaggagagcactcatgacgaacttcgccaaggattatgccgatttcggcacgcccatcacctcgctcggcggcgataacggcaagctgaccagcgctgcctcgcagctgctggaaggcgatctggtcgcgctcgcctggggcaaccacaccacccgcaccgaagcgctggcggtgcgcgacgtgcagtcgatcgaagaggccttccgcgcccaccccttccacggcagccatgacgcggcaaccgtgggtgccggctgctgctgcacctgcacccccgcctgctgctgcacggccggcgcggtggtcgacacggtcgccgacgccgcctgaccgaccggcaacaccacccggtccagcataccaacacacgaccccgcccccgcacgccgaccccgaggtgacatcgatgaatgacggcaacctgctgatccggcttctaccgttccaacttgccgagaccgcagccggcacgcttatccgcaggggtgcccttcgcctgatgctcgacggcgacggtatcgcggagatcgtggcccggctgcaggaggtcgcgtcggatgcattctgcagccggcacgacctcctcgccctgttcccgccgatcgaccggccgcgggtcgatgcgctgctgcgcgaactggcgatccgccgcctggcggagctgcgcggcccgggcgcccccaccgacgccgccccgcgccacgaggacagcgaggatgtgttcttctggcagctgggcatgacccgcgaccagatccgcagcgcgaccggcggccggatcgcactggtgggggtaaatgccctcagcctggcgctgatcgaccatctcggccgctatggcacctggcaggcggtgctgatcgacgacgtgccgctgcgcaaccatgcgctttacgagcgcggcctgcccgcggggctgaccatcgtggatgccgcagaggccgacgaggcggtgcgcgccgccaacatcatggtcgcctgcgccgaattcggcgggcttggcctgctgaagccctggaatgccctggccgccgccgaaaaccgccccttcctgccggtgatcgtcgaggatctgaccgcgcgcctcggccccctgtcgatccccgacgagaccgcctgcctggaatgcctggacgcccggcagaattcccatctgaagggccgcccgtcggaccgccgcctgatagaagagatcctggcccgggggcaggacgtgtccggcacccatccggcgctgatcgccatggcggcaccgctcgccgccttcgaactgctgcgcttcgccgccgacctgctgccccgccgggtgggcaagctgatcgaactcaacctgatgggatcgagcatggtggcgagccgggtgctgaaggccccgcgctgcccggtctgcagcccgatgaaacacgccggcaagctggcgcttgaaaaggtggtgctgaacccggagcgctgggccgaagtggaagcgatgggaggtcccgatggcccgcgttgagaacctggaccgcgttgagggcctggatcgcgttgagggcctggatcgcgttgaaggcctggaccgcgtcgggccccagggccacgtggaaacgagggtgggggccatgcccctgcgccgcggcatccgcacccgccggccgctgggtgccctgcccgatatcgtgcccctgctctacgaccccaaggtcggcattctgggcgagatccgcgagcatgaccgcgaggccggctctcccgaatatttccgctacgtcaccacggccggcgacaccaccgccttttccggccatcagaatttctcgatcggcggcggcggctccacctcgcgcgggatcgcactggccaaggcgatcggcgaggccatcgaacgctatgccgccgcggtctatgaccgccgcgactacccgatggtgccctatgacgcggcgccgttcgactgcgtcgcgccccaggatttcgccctgttcgatacggcccagttcgacgatccggacttcacctaccagcccttcaacggccagtcggatgtgcgctggatgccggcgaaaagcctggtctcgggccggatccgccatgtgccggcctgtttcgtacacctgccctatctgtttccgcgcaatggcgacgaatggccgctggcccagtccatctcgaccggccttgcctgccatggcagcttcgcccaggcggcgctcggcgggatctgcgaggtggtggagcgggactgcttctccatcacctggcaggccatggtctcgcgcgagaggatccgcccggaaagcctggccccggcccatcgcgacgccatccggcgtttcgtggcggtgggctacgacgtccatatgatgaatatcagccacgacaatcgcatccccacgatcatgaccgtgctctgcggccggcgtgcaggcaatgcgccgctggccgtcgccgccgcgaccgacctgtcgcccctggtcgccgccaccaaatcgctggaagaactggcccataccgaacgctatgtccgccagctgatgggagagctggggcggatcgagatcgagcccgggcatcgcaacgtctacagccaggtcagccatgtgaatttctggatcagcccggaacgggcgcggcatgcggatttcctccacgcctcgccgcgggagatcgatctggccgacctgccggaccgcaccaccggcgatccggcaggcgacctggatgccgtggtcagggccatcgccggcaccggccatgacgtgctgatcgccgatctggccacccccgatgtcgcggcgctgggtttccacgtggtgcgcgcgctcgtgcccggctaccacccgctttacatgggctatcgcctgcgggcgctgggcgggcggcggttgtggaccgtgccccaggcgctgggccatccgggcatcgaccggtcgaccggcgacaaccccatgccccatcccttcccctgacggccacccggcccccgatcgcggagcaccccccatgaaagctgatggcccgagctgggacgacctcgtctggggcgaggcggaaaccgacctgctgtgggagacctttcacgagaacagcaaatcctcgggctatgacgacgccctgcccaaccaggtggtcgtggactggatgacccggctgaaaaacgcgctggtctatgacagtgccgatgccgtgcccctgcccgggccggagcggtttccgcccttcacccgcggcctgggcgaggcgatcgcccgccgccacaccccgcgcggcctggtgccgaccccgatgccgctggagacgctggcctcgctgctgcaccacgcctatggcatcaaccgctggaatgagggcacccatttcccgcggccgttccgcaatgtgccgtcgggtggcgggctgttcccgctggagctgtatgtccacgaccgcggcctggtcgacggcctgcagcccgggctgcaccattacgatccggaaacgaactgcctgcgccggatcatggatggcgacatgaccgaggccttcgccccctgcctgtatcagcccgagatcatccgcggtgccacggtcgccatcttccagaccgccctgttccggcgcagcaccttcaaatatcgcgaccgcggctatcgcttcaccctgatcgaggcggggcatgtggcccagaacctcaatctggtcgcgaccgcgctggagctgggggtgtggaatatcggcggcttccaggaccgcaggatcgatcgcctgctcggcatcgacggcgtcaaccacgccacggtctatatgcatgcgatcgggcgggaggccgtctgacgtggacagccatcgcacccccgcctcagcacagtccggcccgataccgcccgcccccgcgccgcacccggccttcgtggtggtctgcgaaaccgatgccgatctctgccgtctggccggccggctggccggcgccgggccgctgctggtggcggatctgagcctgggcagctggcgggggcactggctggcccgcgagctggggcggcagctggggctggatcttccggacgatcggggccctgtccccggagaggctgccgggggcccgccggccgagagggtggtggccgccctgatcgaccgcgagaccatgggcgacgccaccgtgctcgccgcccatcatgccgcggtggcgatcgccgacgccgcgcgccggcagggggtgggggcgatcctgatcgccgggccggccagggatcacggctggatggccgaagatctgtggctgctgcggctgctgaaccggttgagcgaactgaccgtggccgtggcggttcccgccgatgccccactctctcccgacgaactggcgccggccgagccgccgatcgcagccgacggcccggtcgccccgacggtggcgcagccggcggaccccgaccggccgggtctaggctggccggaggatctggccgatgcgggaacgggcgacagccggcagatgctgcccgcgatcgccggcctggcgggggcggcattgatcctgcctggtgcgcgggcagcggcggcagccggatgcaccgaggtgccggcgaacccgccgctctggcagcgcgcccgcaccgaggccctgaagccggttgcggaccggcggcccgagatcctgtcggccggcgccgcggcagcctttgccgagggcggctggcgccagtcgctgcggctgatcgaggccgcactgcccgccaccgcggatgccgaaacccggggcgcgctcgaagcgcaggcccaggccatgcggatcgcggtgatggatttcgccggcgccgccgaccggcccgatccggagccgggcctgtcggcaccgcttcgccgcgagcttgccaccgccaaggcctgggggctggtgatgaccggccggccggccgaggccgaccggttgttcggcgaggcccgcgccctggccacgccggccgaccgcgacccgatgtggctgtatctgctgaacatttcggcactggcgaagctgcgcaccggccggatcgacgatgccttcgccttcgagcaccagatcgaggcccggctgcgcagcttcgacccgccggactggcatctcagctatatcaacgccatcaacctggcccggctgcaccgtcaggccggccagatccccgaagcgcgggcctgttacgagcgcgccttcgcgatcacgctgggcctgcgttcggaaagcgaccagctttatctggcggtctgccaggccgggctggaacaggccgaggggcggatcgccgaagccttgatcaccaccctgcgcgcagccctgcactggctgtcgatggccgtgcccgaagccctggcgccccgggtcgcccgcgccatgggggcggttccgggccccgagctggtcgcccgggtcgacgattatctgctgggccggttgaccgcgctgctggagaagatcggcccgcccttcaaccatctggcccgcgacccggcggaggacggcccgagatggcggcgggcggagggaaacacctccgggtgcaccgcctggggcggccccggctggggggtgctgatccgcccgcgccctatgggcgaggaccagcccgggcaggcagaggcggggcgcgacggcggccggttgggggcgcttaccgcgcggatcctggcccggctgagcccggcgccgatggcgccgggcgatgcctgcatcctggtcgatggcggcttcggcaccgatgtgccggtgcggctgcccgagctgatcggcctggccctgcgccagggctgcacccggctgcgcttccgcgaccgggatctggtgctgacggcggcgcaggcggcggatctgctcgaccgctgccggatcgggccggggccggggatcgatgccatcgaccgcgcggccgatggccggctggcggtacgattccggcgggtgcggccgcagctggtggtggcggcggacgacccggccgccatggccctgaccgcgaccgatggcctggtcttcgccgatctgcaggcgcggaccgggctggaccggtcggtgctgctggcggcggtgcgtcggctggaggcccggggcgcgctggcggttgcggtgccggccgggatctgatggccccgccccggagctgccatctggccttccggctggaaccgcagatcgcgccctgcctgtgctgggcggcgctgggcagcgcccttgccgtccattacggcctggaggatgcgccggggcagcgggatctggtgatccggatcttcggccggtttgatccgaaaccggccccggccgaggccgtgcttcaggcgctgggcctgctgaaggcgcagatcgaccggccgctgacggccgaggaaatccgggccgagatcaccgccggccgggtgatcgcggccgagatcgcgctggggttcggcggcgcccatctggtggcgatttccggcatcgccgccgatgaccgggtgcaggtggacgacccccgcagcggccggagcctgatgccgcgggccgagctggtggccgaccccggcggctggtggtcgtggcggcgcagcttcctgaccggtccgccggattgatggcggccccggccgggtgcggttcaggcctgcgaggcgatgcagatcagcagcacccagaagaacacgaaccattgcagcagacccatcatcgcggagcccccccgcccgccggggcggctgcgttctcgcccatcccgtcggtttcgagcgtcggcccccgggattgcggcagatcgaagacctgcgcggcgccgccctccgcggccgcgacctcgatgcgtcccgtgaagcgggcaccggtcggggcctccccctctacctgccaggcgccgggttcgagcgtggtctgccagtcgccggtgatcgcctcgggcatcgccaccgcctcggacgcctggccgtccagcggcaccgccgaccagccgaccggcaggccggcatgggcctcaccgatccggatcaccaccgggacggggctggagacagcctcctccgccggcttgtagggccggaccagcagctcggcatcgggcttcatgcccgaggcccaaccttctgagggatcgtagtcccgcatgtccatctcggcatcgtaggcgaagcggaagcagcgggcatgctcgacgaaatagctgcccttgggctcgtagcgccaggcggcgcaaagcctgtcaccctcgcagctcgccgcgcaccgggcgatgctgccctcgggcgggaacggcaggtcggccggcgcctctgcatccgggccgaaggtctggccggtcggctccagggcgatatccggcatcatcggcgcgccggggaaatgggtccggggcggggtctcgggcaccggcgtagcggcaacggtctcggccagagcggttgcgagcgtcgcggcatccgaggcttcgatatagcggccgccggtggcgtcggcgaggcaggcgacgcccgccccttcttccttcgtcaggccgaagccgatgacatgggtggtgaaatcgacacccgcggcctccagctccgcgcccagggcgcaggggtcggctgcgcaggtttcaagcccgtcggtgaccagcaccacggtggcggcgtcctcggtatagcgcagcgcctcggccgcctggcggacggcggcggacagtggcgtcttgcccaggaaacgcatcccgtccacggcctggcggatggcgccggccgtgccggaggccgggggcaccagcaattcgatgtcggcgcaatcgcccttgcggcgatggccataggcgatcaggccgaggctgcgcgcgggatcgacgccttccagcaccgcggccaccgtctcgcgggcgatctcgagcttcggccgcccgtcgatctgcccccacatcgagcccgagccgtccatcaccaggatcgtggccgggccctggggtgctgcatccgccgcccccgccgggtcgactgttgcgatcgtacacatcccgatcgccatcgcatgcatgaggccaagtgcggccgcatgcatgccgcgtgttcgtgcggcaggcttcatgcgcatctgctcccgatctgcccgttgtgccggtccggccggcttgctgcggccgttgacggaaaattaacgatgatcggggaacgggcacactaccagatggtagggaggtggcacatggttggggggtggcggtttgggcagaagccccgctcagacggctagaaccgttcagagaggcccgcgcggccggcgagtagcagcgcctggcggaacaccatgtcgccatggctgagcggcagggtgtggccggcatcgccgaccggctggaaacggccggcggggagcaggccggccagctcggtcacggcctggcgcgacacggtctggctgcgctcgccatgcagcagcagaacctcgcaggcaacacgcggcgccagatcgctccagtcctcgttggtcagccgcatgtcgtggcggaagcccagccccttctgacccgacaccagcgcgaagctttcctgcagagagggtgcgaagcgcggatcggcccagaggtcgcggtcgaaatcacagtcgctgaacaccaggccggggatcagatcaacgcccttgcgcgcgacctgggtgatgccgagcccgacgatcttatccatcagcgccggcattttctgcgaggcccaggcattgacccggtggcgcagcggcatgtcggaggtctggccccagccgcgcatcggcggggtggccggggcggcgacgatccccgccacccggtcggggcggcgcagggcaaaatcgatcgcgaaacgggtaccgatatcgtgggccaccaccacggcgcgcgtgatgccctggcgatccaggatggcgtcgatccgggtggcagccagcttcaggggatcggcgcccggggccagcggggctgcgccatagccgggacggaccggcgcgatcacatccagccccagggtccgggcggcatggcggatgtcaggctgggcggcgatgccgaacagcgcgccgtgcagcagcagcaccggaaacccgcccggccggccgaaacggtgcacgggcacggggccatcggcggtcggctccagcagggacgcggccgagggggcgtggaggcgcgggccgctgtcgctcaaccgttcggccgtcagcatcagcgaataggcaagcgccaccgcctgggtctggctgtgcacgcccatcttggccagcaccgccttgaccagctggcggatggtcgccggcttgcggccggtctcggcggcgatcgcctcgatatcgcggccgtccatcagcgcgaacagcacacgtagctcggacgggatcagcccgaaaaccgcggtcagccgcgcctccagcgccgtgtcctggccacgccggcattcgaccagcaggatgtcgccgccgcgttccggcgccatgccggccagcagcagggtccgctcgcgcatgtcagccacgaacagcgccccggcctcgcccgtgcggcgcacggcttcaagaaaggccgtgtggctgccgggcgtcagcaccaccgcacccagctcgtcgcccacctccagcgccagacgccgcgcggcggcggcattgcgactgagcacccggcccgtgggatccaacaccagcatcacgccttcatcggcgaagccggcagcccccatcgcctcgaagatcgccggcacgtcggccatcatcgccgacagccgatcgatcccgccgcggccttccagcacatcggaaatcagatccaccaggcggcgataggccgcctcggtgctctgaatggggggcgcctgaatgggtgtgttccgtgccggtccggccgcatccgcggtcatgcgccgccctgccctgcaggtgttggagatcggctcagtctatatcagggcgggggtggatgacatggcctggattggggggcagacaatctggaagatgcataaccaacacctgtacgaagcgcgtaggcacgacgcgtaaacacgatacgtaaacacgacgcgtaaacacgacgcgtaggcgcgttacataagcgcaaaatctgtacgcatatccattaccccctccgatatacgataatttatgcgttgtggagcaccacgttaatctaagtatttgataaatatgtattttcttttgatgcctgatccgcttaaagaccttgacgccacccgcatgctgagttatcacttgatggtcgataggaggtccgccatggctgccattcagcgaaagaaaagcccccgcgctccatcttttgggcttcaagatgcgatcgagcgtgcgttcaagatctatgatagggaaggccgtcatgcggttcccgtagatgttgccgcgaaccatcttgggtacaaagatgcaagtaatggtgcggccatggcagcccttgcaacacttcgttactatggtctaatcgaacgaccccgagagggacaactagctatatgcaaagaattggaactatataaattttcaccgaatgacgaaattcggatgaaactcctcggaacgtggataagaaagccaccaatattcaatgagcttttagatcaatacgtcggcggacttccttctgatggtaccattagatatgatctcatccaaaaaggcttcaatgcgagttccgtagactcctgcgtctctgctttcagaagctctgtggaatacgcacgtttctacgatgcacctgcgggcagagtggaggcagatgagcaggatgaggaggaacacgaccttccggagagtttagaacaagcgcacggcactcccacaccctcctcgcacagttcatctctcccagagaggccaagtacggcaaagatcaagccccccctcctcctttccagcgacgacacagcggagattgataagatcccaatacgcctgactggagggagaagagcctggatcgtcgttccgtcgccgctatacacagcggataaggaccgcatgatcgcacagataaagctactactgaccgatgacgaagaaactgaagagtagtagctaaagaaaaggcccggagcagctgcaactgccccgagccccaaatctcccacggacacggaaatcatccaatgggaggccggctatgccgactcacaagatgggatactcaatccctaaggtcgccggtgtcaagagatatcttatgcaaaaggtgaaacatatgtcaccgcatgagcgtccagcacccgcaggataccgttgggtatactgcaagtgcttcaggcactggcgtacaaagaagattgtctaccccaaaaagggagactgcttcatgttcctggtgcgctgcaaataatctataactgcacaagcatcccaccaatcccatggtgggatgcttgtcgtgtcaacaataatgacggcgctatgccgatttagaccagaagaatggctggggcgccaggattcgaagccaggacgcgcccaaaacccgtcggaaacacaaggaaacggacgccttccgttccgatgccggggctggagtgctccacacgaatgctccacagtcccgccaatgccgccgattctacgcgacgaaacgacgggcgccaagggggtaggaagcagcgctcagagggatcggagtggcggccaaccagaccgtgtgcttaaattccgcgccgccgaacagcggtggttggggcattcaccgtacggcgggacgtgagaacgctcagggttgagaaagggggccttccaccatgacaccgaccgagttcgtcgccaagtggaaggcgtccacgctgacggagcgcgccgccgcgcaaagccagttcgttgacctctgccggctgctggatgaacccacgccgtcggaagccgatccgaccggcgaatggtatgccttcgagaagggcgccaacaagaccaccggcgccagcggatgggccgacgtgtggaagcgggggcatttcgcctgggaatacaagggcaagggccgcgacctgaacgccgccttcgcccagttgcagcagtatgccggcgccctcgggaatccgccgttgctcgtcgtgtccgacatgcagatcttccgcatcacgaccgcttggaccaataccgtctccgaggtccacaccctgacactggacgaccttctggacgccgagaagcgccggctcctgaagtgggtgctgtccgcacccaacaacctcaagcccggcctgacccggcaggccctcaccgagcaggcggccgccaccttcgccgcccttgcccgccgcctgcgcgagcgcggccacgatccgcagcaggtggcccatttcgtcaaccgtctggtcttctgcatgttcgccgaagacgtggacctgctgcccagttcgatgttccaacgcctgttggaagcctgccgcgccaagcccgaccagttcgagacgatggcgagcaccctgttcggcgccatgcgcaccggcggtatggttggcttcgaggtcgtcgagtggttcaacggcggcctgttcgatgacgacagcgccctgccgctgacccgcgacgacctgaccgaagtcctgtccaccgcccgcctggactgggccgaggtagacccgtcgatcttcggcaccctgttcgagcgcggtcttgaccccgataagcgcagccagttgggcgcccactacaccgaccgcgacaagattcagctcatcatcgagccggtaatcctgcgtccactgctggccgagtgggaggcccgcaaggccgacatcgccgccgcgctggacaaggcccgcaccgcaaaggctcccggcactcgcacgaaggcgcgcaaggaagccgaaaccctctaccgcgccttcctggaccgcctgcgcgccttccgggttctcgaccctgcctgtggctccggcaacttcctgtatctggccctgctgacgttgaaggacttggagcaccgggccggcgtcgaagcggaagcgatgggcctccaacgcgagttcccggccattggacccgaagccgtcaaaggcatcgaaatcaacccttacgctgccgaactggcgcgcatctcggtgtggatcggcgaaatccagtggatgcgccgcaacggctacaacgtgccgcgcaatcccattctgcgccccctggacaccatcgagaaccgcgacgcgctgttgaacgccgatggcagtgaaaccgcgtggccgaccgccgacgtcatcatcggcaacccgccgttcctgggcggcaagttgctccgcacgatgctcggcgacgatacggtggaacgcctgttcgccgtctatgcgggccgagttcccgccgaagccgaccttgtatgctactggttcgcgaaaggctgggagatgatccgggcggggcgcctgtcgcgcctggggcttgtgtccacgaactccttgcgaggtggcgcgaaccggcgcgttctggaggcccctgcggctgcgggagccatcttcgacgcctggaatgatgagccttgggtggtcgatggagccgcggtgcgcgtgtctttggtggctttgggcgcgccgggccacaccctgcccgtccgcctcgacggcgccccggtggagcggatcaacgccgacctgtcagccggcgccactgacctcaccaccgccaagcggttgccggagaacgcgggcgctgcgtatatgggcgacaccaagggcggcgcgttcgacgtggcgggcgaccttgcccggcagtggctggccctgcccctgaaccccaacgcgcgcccgaacgccgacgttctgcggccttgggtcaacgggatggacctcacccggcggcccgccggcaagtggatcatcgacttcggctggtcgatgagcgaagccgatgctgccctctatgaagctcccttttcccatgtgcttgctcatgtgaagccggagcgagacaccaaccgccgtgaaggctaccgcaccttctggtggcgccatgtcgaaccgcgccaagggatgtggcgcgccctgacgggcttgccgcgctacgttgccaccgctcgtgtctccaaacaccggctgtttacgtggctccctgcgtcaacggtgcccgacagccaagtcatcgtcatcacgcgcgacgacgacacgaccttcgggatcctgcacagccgctttcacgaagcttgggcgctgcgtctgggcacgagcctggaggaccggccccgctacacgcccagcacgacattcgagaccttccccttccccgacggcctgacgcccagcattcccgccgccgactatgctgcggatccgctcgcccaggccatcgcccaggccgccgcgcgcttggaccagttgcggcgcaactggctcaacccgcccgacctcgtggacgtggtgcccgaagtcgtgcccggcttccccgaccgcctgatccccaaggacgacaaggccgccgccgagttgaagaagcgcacgctgaccaacctctacaacgcccgcccgacatggctcgccaaggcccatgccgacctggacgccgccgttgccgccgcctacggttggcccgctgacatcaccgaagacgatgccctggcccgcctgctggccctcaaccaccagcgggccggcttggcggcggcacccgcgccaacgcctgccgacgtggacgcctgaccgcgcttcttggcacgctggcgccggtaaattccgttgcttgccggatcacgaaaaatcgaatggcagacgatacgggaatagcctgggccggcgacgctgaacggatgggggccacttggtccgcgtggtgggggtgttcgaagctcgtcgaaaagcggcccgcctggaagcccgtcggctccgcgtgcgacttctgctatgcggaagcgaatgcagagccgaagcgccgggggctggccttgaagaccggcgcgcccgcaatccccctgtggggcaaggccggcgttcgtcagaaatgcagcagcaccggaaacccgcccggccggccgaaacggtgcacgggcacggggccatcggcggtcggctccagcagggacgcggccgagggggcgtggaggcgcgggccactgtcgctcaaccgttcggccgtcagcatcagcgaataggcgagcgccacagcctgggtctggctgtgcacgcccatcttggccagcaccgccttgaccagctggcggatggtcgccggcttgcggccggtctcggcggcgatcgcctcgatatcgcggccgtccatcagcgcgaacagcacacgtagctcggacgggatcagcccgaaaaccgcggtcagccgcgcctccagcgccgtgtcctggccacgccggcattcgaccagcagaatgtcgccgccgcgctccggtgccatgccggccagcagcagggtccgctcgcgcatgtcagccacgaacagcgccccggcctcgcccgtgcggcgcacggcttcaagaaaggccgtgtggctgccgggcgtcagcaccaccgcacccagctcgtcgcccacctccagcgccagacgccgcgcggcggcggcattgcggctgagcacccggccggcgggatccagcaccagcatcacgccttcatcggcgaagccggccgcgcccatcgcctcgaagatcgccggcacgtcgcccatcatcatcgacagccgatcgatcccgccgcggccttccagcacgtcggaaatcagatccaccaggcggcgataggccgcctcggtgctctgaatggggggagcctgaatgggtgtgttccgtgccggtccggccgcatccgcggtcatgcgccgccctgccccgcagatggtggagatcggctcagtctatatcagggcgggggtggatgacatgaccgggatgggggggcccaggtcggcggtcccgctggaaatcggcatataccaggcataagttatcctgtgtcgtgcccccggagacccgttcatgccacgcaccgtgcggccggactggctgtcatttgccgaggaaccggaggaagaccaggatttcctgcgtgagcgtccggacctgatcgacgagggacgcttttctctcgacggtgatctgccggacgacaagaccgggacgcgctgatgcctgcggtctacatgctcgacaccaatatctgttccgacatcatgcgggatttcgcgcgtggcgaggctgcgcgtcgagggttgggcggcggaggattgagcagggtgaccggcgccgggaggcggccaggatccgataccggatatggctggggcgccaggattcgaacctgggatcacgggaccaaaacccgttgccttaccgcttggccacgccccatcgcgcgggctgcaacatagtacggacccggacggctttcaaccggatcgggcgggggtttcacggatttcgggcgggccggcgagcagcgggccggtggccgtccaccagccggggtgggctgtggagatcaggctctgggcggcttccgcggcagcggcttcggtgaagagcgcgaagcaggtggcgcccgatccggacatgcgcgtgaaacatgcccccgccagccggccaagtgccgcctctgcctcgggaatttcgggaaccaggctgcgggcggcgcccgagaggtcgttgccggccgccccgagtgccgccagccacgcgccgatatcggcggtatcgggggccggcagccgggccgcgggcgtgaagccggcgccggcggcggcgcgggcacggaacaccaccggcgtcgacagcggcaccagcgggttgaccagcaggatgtgcaggcctgcgaaggcggccgcggccggcgcgtcgagcggtgcgaccacctcgcccaccccggtcacgcggcagggtgtggcggtgacacacatcggcacgtcggcacccaggccttcggccacggcctgaaggtcgtccgccccggcgccccaggcatggcccagcaggcgcagcaccgccgcggcgtcgctggagccgccaccgatgccgcttgcgaccggcagatgcttgtcgagccggatccgcgccggcagcggccggccgagccgggcggcgagccccgtggcggcgcgcatgacgagattgtcggccggggcggtgtcgcccagcgccgcggcgaaagggccttcaagatcgaaaccggtgggcgttcccgcaggcgccggacgcggatcgaccaccaccctgtctcccgccccggcaaagaccaccaggctgtcgagcaggtgatagccgtcatcccggcggccggtgacgtgcaggtgcaggttgatcttggcaggcgccagggtggagagcatcagttggggaggggcggtcacttgggggcgggagccgcgacggggatcacgctgcccgcgggcgccggcggcaggccccgggccagcttgccgcggatgatctcggcctgtttcggctcggggtcgaaaaccagggcatggctccactggaagcgggcctcgcgctcgcgcccgacccgccaataggcgtcgcccagatgatcattgatcgtggggtcgttgggctgcagcagaaccgcctgttccagccgggcgacggcgccctcgtaatcgcccatctggaacagcgcccagcccaggctgtcgacgatgaagccgtcgcgcgggcgcagcgtcaccgccttttcaagcatggcccgggcccggtccaggttcatgcccttctcgacccaggaatagcccagataattcagcaccagcggctgatcgggcgacagctgcagcgccttcaggaaatcagactcggcctcgggccagcggccggcgcgctcataggcgacaccgcgggcataaaacagatcccagtgttcgggaccgggatcgaccagggccgcaagcgcgctgctataggcgcgggcggcatcgtcccagcgttcctgccggcgatagagttcggccaggctgatcgccgcatccttctggccggcggccacccgctcttccagcagcgcctcagccccgtcgatatcgcccgaggctgcgagattgtcggcgatgcggatcgccgccgcctcggccacggcaccgccatcgtcgatcttgcggaaggcatctagcgccgaacggtgatcgccggcccgctcgtaaacctcgcccaccagatagcgggcatcggcgaaatcggggcgcatgaacaaagcgagccggccgtagaacagggcggcccccagcacctgatcgcgcagcagcaggccggcgacgccgtaaagcgcctcggcgatgccggccttgtagtcgggcaccagccgcggaagttcctcacccgcctcgatccgcgccagcgcctggcgcagcgtcgtgctctcgggcgcatcgcgcagaagctggcgatagagatcggccgcctggtcgcggttgccggtgcggacgagatacgaggcgtaggactggatcagccgcacgggcgtcggcccgccgctcgacagcgccacctcgtaattggcccgcgcgcctgcatcctgtccggccagatcgtggatcagcgctgcataataatagcggtaggtggcgaaagccggcgtgccggccagccggtcgagcgcggtgaccgcctctcccgaacggccgcggccaaaacgcacccaggcatcgaccacgggggcgagcagcgcgttgacgccgccgcgatccatgcggtcggccatgcgctcggcctcgatcagctctcccgcctggatgcggtccaggatcagcagcagatcggcgaacggggcggccggctccagcgcgcgcacgcgctttgcataatccagcgcctgggggatgttgccttcgcccgccgtcagcagcatggcgcggcgcagcaattccgggtcctgcggcgcctgatcgagcgctgcacgatagaaggcggccgcggcggtgaaatcgtcacgggtctgggcatagcgcccggccagatagttgccggtgaaggtacggccgacctggacatccggggccggcccggtgcccgggctggcgcaggccgccagcaacagcgtcgccatggccgcgaaaaccaccgctcccgcccgtctgctgcctgcccgtgtcatgcgaaggtccatcccgtcgatcggcccctgccggcccggaccacggtccgaccctccggcttttctggatgcgccccggctccccgggccgccattcgtcgcaccatccgcggcccgcggcaagggggccggcggtttggctggcgactgcgacattttcgtctcgcaccgcgttgcggcaatgccaccattggacactctggccatgcccctgtccagcgcagacggccggcgccggccggagccatcgcatggctgaagatcaacggcgcgacccatgcagacaatgccgggctcgacacttgaccttcggcccggtttgacgcacaaatcgcgggttacagcagggccgcgccgtcagcaggcggcgggagcccgtatcccgaccggttccggtccgttctcgcctgccgccctcttccccgccgggaaggggtcgccgcgggcgtggccgtgtcccgggcatacggtcagagcgggcacggcccgcgtggcgaacgccgcaaggcgggcgcccgtaccttgaggaaatggtgccatgggcagcaagaacaacccgaagaaccgcggcgctgctgcggttgagaagaccttcgacggcaagaaggtgaagccggtcctgtatgtcggctcgaatgtcggccatggccgctacatcgccgcccaggacgagggtggcaagctggtgaacgacgccggcggccgcccggtcgcgtggcgcgatatctgagtctttaattcagcccctcggcccaagcggccgctaccgcggccttggccgccgcctcaatggcggctgggtgccgctgagcggcaccggggtatgaagacggacgacacacaaaacggccgcagtcgggaaaccggctgcggccgttttgtgtgtcggggatcaggaggcgccgcggggcaggaagggtgtggtggcggcggcgcggtcggcgtggcggaccaggccttcggccatacggtcgtcgaaggtgacgtcgacccggacgtcacgcacggcatcgccacgccagaccgcctcgcccgcttccaggcgcagcttgccgccgccatgggccggcaggccgcggagcgcaatacggtcggcctctgccaccgcgtcgcggccggtcatataggcatcgaggttgagacggtcgaaggcgacccggccgcccaggcgccaggcctgatcaggcccgccccaggccgccgacagcccgcccgatacctcggcgccgtcgaaggtgcccgaaagatcggtgaggcccagcccgccgggggccagtgccgccgtggccctgagcgccagccggcccaaccggcccggggctacgcccggctgctcgccgccgttgaaggctgcaatcaggcccgagaccgagcgggcttcgagcgtcatgatgccgtcgaagccgagcccgccggcccgctggcccacacgcccctcggcatccagccgggtggcgccggccgggctttcgaccgagaaggccggcatcagcacatcaccaccggtgcgcgggtcacgcttcagcgtgacggcgagatcggagagcgccggcatcgccgccatcccggttgcgacagaggccgcggtgaggtcaaggtttgccggcagcgcgccgagcagggccgcagcagcgcccggggccgcggcggcttcgatccaggggccggcatcgaaacggcccagatcgatgcgggcagtgacgccgccggccatgccgtcgggcgcccaggcaagttccccctcggcccgactgtcgccgaggctcatctccgcacgggtcagccgggcaccggtgtggtcgaccttgagcgcaccggtcagacgcagcggcaggccgaagggcaccggcggcggggtggtggcacccgacacgtcggaaaccagcccggccagcacgccggcatccccggccctgagatcgatgctgccatcgaaaccgccgggcaggatccggccgtcataggtgaccgcggcaccgccggcggtgagcgtcgcacggccggcgacggcgcgcacgccctcgcgatcggccgcacccagacgcatctccaagaggatgggcacgccgcccgccgacatccgcccggcgagttcccgcccgcccccggcgagcgcctggctttccgcctccaccccatcgagcagcacccgccgcccgccgccgaggccaagatccagaatgccgttgtgaatggtgagatcgggcgcgcccgcaatcagaaaggaggcggcggacgccgccgccgttgccggttttgccccggcttcgggcccttcttccagggcgaggcgcggcccgtcgagcaccacccgccgggggctgagcccaccgcccagaagatcgccgaagccaagccccatcgagagatgatcggcggcaaaggcggtttgcggatcgtcgccgatcagcacctcgtcgaggcccagttccggcatggggaacagccggagcgtgatcggcccggccaccgacacccgggcgccgatggcatcggccagccggccgacgacgctctgggccgtggccggcgagacctcgcgcagatcccggcccggcagccagacggcaccggcaacccccgccgcggccaatccggccacgacgatcacaccggtcgtgatcgcgatacgggcgaacgacatcgcctctccgttccctctggcgttccggccgcctttccggcggtccggtcgggcctgcggccgcattcctgccggacatccccctcagaatgcccctcgcaggatggcggtccgcgccctagattctcttcccgccggcccctgccggcagcgccgcccttgcggcgtcattgaccctagccggggccgcgcccatgggcaactctgcccgtgaccggcgatgtccgcggcagacctgccggaggagacgtcggccatgggtgacgtcatcaacctcaatgccgtgcgcaagcagcgcgagcgcgcggccaaggaagcccgggcggccgagaaccgcgcccgtttcgggcagagccgccttcagcgcgatctgcgcgatgcggagcagagccgtgccgagcgcgagctggaccgcaagcggctgtccttcgacgacccggacaagacgcccaagcgttgatcggggccgggcgttgatcggggccgggcgttgatcggggccgggcgttgatccaggaccagccgaccgccgccggatcagccggcgacgagcggccgggtcaccgcagcaagccagcccctgacgccatcgtcgaccaggggcgagacctcggccagcacccgcgcgtgataggcatcgacccaggcgatttcgtcggcggtcagcatgtccacccggatcaggctgcggtcgatgggggcgagcgtcagggtttcgaagccgaggaaccgccggccggcgaagccggtgccctcgtcccgcaccaccagcaggttctcgatccggatgccgtagcggccgggctcgtaatagccgggctcgtcggacaggatcatccccggctccagcggctggctcgacagtttggaaatccgctgcgggccttcatgcaccgacagatagctgccgacgccatggccggtgccatggtcgaaatccagccccgccgcccagagatcgcgccgggccaggacgtcgagctgggcaccggtggtgccggccggaaaacgcgccaccgccaccgcgatatggcccttcagcacccgggtgaaggcgtctgccacctctgccggcagatcgcccaccgccacggtgcgggtgacgtcggtggtgccgtccagatactggccgccgctgtcgaccagatagatctgccccggctccagccgccggttgctgcgctcattcacccggtaatgggccatggcggcatggggccccgaggcggagatggtctcgaagctcatgccccggtagtgatcgagcccggcgcgcaaccggccgagttcggccgcggcgtcaagctcggtcagatggcccttgggcgcctcggccgcgatccaggcaaggaaggtgaccagcgcgccggcatcgcgcagatgcgccgcccgcgtacccgccagctccaccgcattcttgcgcgccttgggcagcgagaccggcgagctgccctccaccaccgtggcccccgcctgcttcagccggtgatcggcccagatattggcggtggtggggtcgatcagcacccggcgaccggcgcagtcgtcgagtgccgcccccagcgcctcgacgcccgcgacccgtgcctcgcccgccagatggtcgatcacctcgggcgtcagcttgcggcggtcgatgaagatctgcgcctcgccgtcgctggcgatcaggccgaagcccagcggcagcggcgtgcagggcacgtcggcgccgcggatgttgagcagccaggccagttcctcgggcatggtgatcagataggcatcggcgccggcggcggcgatcgcctcgccgatgcgcttgcgcttggaggccacgctctcccccgcgaaggcctcgtcatggggcaccacgggggcaagcggcatggcggcgcggccgttccagatggcatccagcgggttgccctccagcgccgcaagctcgacgccggcacgcgccagcacgcgctgccagcgcgaaatctcggccggggtgtgcagcctgggatcatagccgatccgcgcaccgcgcccggcggtctcggcgatccaggcgatcggcgtgcgctccaccacatggcagcgctcgaacacctgcccgtcgacctcctgctcggcctggatggtgtagcgaccgtcgacgaagacggcggcccggtccttcaggatgactgcggtcccggccgagccgtggaaaccggtgatccaggccagccgttcggccgcgcgcggcacgtattcaccctgatgctcgtcggcgcgcggcacgatgaagccgtcgacccccgccgccgccagccgcagccgcagccgcgccacccggccggccgtgtccggcgcctcgtcccagagcccgtcttccagccgggccgcaacctcggcccggcgggcgaccagcgctgcgaccaggtccggatcatgcgggccgcggcccagaaccagatccacccagcgcaggtcgccggcaggcgatgccgcggcatcgatgccggccagcagggcgtcgagcccggccgcccccacccgtgcgccccgggcggcaagccgccgggcaagctcgtcaccatcgagcgacagagagatcggggcagcggttccgtccggggtggaagcggtcatggggtcaggcctcatcaggaggaagggcggttcagtcctgacggcggggcgcccgccgcatcatcagcgtggtccagccgtcgagcaccaggcgcttgtccagcaccaggccgcgacggcgataggcgttcagcacccagctgtcctggcggggggtcaaccccgacagcaccagccggccacccggcgccagatgccgcaccaccaccggcgccatccgcgccagcggccgggccaggatattggccaggatcaggtcgtaggggccgtgggccatgacctcgggccggcggaagccttccgagatcagcgggatcacccggtcgcgaacatggttgatgtggatgttctcggccgtcaccgcaaccgaacgcggatcattgtcgaccgccagcacccggcggcgcagccggcgcgggttgaagcgctgcgccgcagcgatggcgagcacgcccgtgccgcagcccatgtccagaacccggccgaccggcttgccgcgccgggccaggtgatcgatcatggtcaggcagccgcgggtggtgccgtgctcgcccgaaccgaaggcctggccggcatcgaccacgatgccgatcgcccccgggcgaaccacctcggccgcgtccagatggctgccatggaccacgaactgcccggcatggatgggcacgaagcttttcagcacgtcgctcgcccagtcgcgatcctcgatctggtcgagcacgggcgtctcgagcgcgatgccttcggcggccgcggtcaacgagatgcgggtgccgatttcggccatgtcgggccgggggccgcgggcatagccggtgacacgccaccacaaaccgtcctcgatcacctcgaaactggtgaggctttcgacgaagggctccagcgcggtctcgaccgcggacacatgctccagacccggaacctccagggtcagccgccagaccaggcgggcgggatcagacgggctcgacaaagcgatcgatcactttcttccggccgaccccgtcgaacaccacctgcagcttgtcgccttcgatgcgttcgatgaagccggtgccatatttggcatgcgacacccgcatgccgatcttgaaggacgaggtatcggcggccctggccgccgcggccgcctgtcccggggtgcggccgctggcgggaccggggcgccggggcgccaccgacatgccgccccgttccaccctgaccgcggtgccgtcgatggtccgggcggtgacgtcgtcggccagccgggtcgcgcggtcatagacttcggtctgggcataggggctggtctgggcgtatgggtcggcacgccgcccggccggctgccagccggcggcgcggttgccgccatagaccccggtctggcccgagagttcgacatgctcggccggcagttcttccacgaagcgcgagggaacggccgacagccactggttgtagacccggcgattggccgcgaagctgatcaccgcccggcggcgggcgcgggtgatgcccacataggccagccggcgttcctcttccagcccgtcgcggccgctttcctccagcgcgcgttcatgggggaagacgccctcctcccagcccggcagaaagacggtgtcgaattccaggcccttggcgccgtgcagggtcatgatgctgaccatgtcctcgcctgcgcgggtatcggtgtccatcaccagcgagacatgttcgaggaaagccggcaggctgtcgaattcctcgaccgtgcgcaccagctccttcaggttgtcgagccggccctgggcctcgggcgtcttctcggtctgccacatgccggtcagcccgctttcatccagcatctgccggaccacctcgccatgaggctcgtgcgacagcgcctcgcgccagccggcgatcatgcgggtgaaatcggccagtgccgcgcgcgccttgggccgcagcccgcccaccaccaccggatcggccgcggccaccagcatcggcagccccgccgcccgtgccgccaccgccacggcctgaaccgaggtgtcgcccagcccgcgcttcggcacgttcaccacccgctcgaaggccagatcgtcggcgggcgtgatgatcaggcgcatataggcgagcgcgtcgcgcacctcggcgcgctcgaagaagcgcaggcccccgaccacccgatagggcatgccgatggtcacgaagcggtcttcgaaagcgcgggtctgatggccggcgcggaccagcaccgccatgtcggaaagcgacatgccctgggcgcgcagatgttcgatcacgtccgagacgaagcgggcttcctcgtcgccatcccagcagccctggacccggaccttctcgccctcgccgtcatcggtccagagcgtcttgcccagccgctcttcattgttggcgatcacggcgccggcggcggccaggatatggccggtggagcggtaattgcgctccagccggatcaccgtcgcctcgggaaaatccttttcgaagcgcaggatgttgccgacctcggcaccgcgccaggaatagatcgactggtcgtcgtcgcccacgcagcagatgttgtgatgggcctgggccagcaggcgcagccacagatactgggcgacgttggtgtcctgatactcgtcgaccaggatgtagcggaagcggcgctgccagtcggccagcacgtcgggatgctcgcggaacagccggatgcattccatcagcagatcgccgaaatcggccgcgttcagctctttcagccgtttctgataggcggcgtagagatcggcaccacggccgcgcgccacctcatgcgcctcggcccccggcacctggcccggctgccagcccttgtccttccagcgctggatggcgcccaccagcaccttgggcggccagcgcttctcgtcgacgccggccgcctggatcacctgcttcgccagccgcacctgatcatcggtatcgagaatggtgaaggtggaggtgagcccgaccagctcggcgtgccggcgcagaatgcgggcacacagcgagtggaaggtgccgaaccagagcccgctttcttccgcgccgatcagccgccccacccgctcgcgcatttcgcgcgcggccttgttggtgaaggtgaccgccaggatctgccagggccgggcgcggccggtatccaccagatgcgccaaccttgtggtcagcacccgggtcttgccggtgccggcgccggccagcaccagaaccggcccgtccagcgcctccaccgccgcccgctgctcggcattcagcccgtcgagataggcatgggcatgggacgcaccggcgccgcgcgcgggatgctgcggcaccgaggcttccggcaggctgaacggatcggacatcggaggggccggctctcttggtctggacgcggggttccgggttcgctggaacataaccgaaacgcggccgcgacgacagccatcggcacgcctgccttacctataccctcggcggtgcatctgcaaggcgtgcgcctgggggttgtcggcctggggttgtcaggaggtacctgggcgggtctgggcctgccagaacctccgcagccgatcgtgaggttcgcgcatccagcgctcacagagcgcgatctcggcggctgaggcctcacgacgcttacggtcaccatcgggaacgaaggccggacggtcgccgcggcccttggaatagagccgcgcctcgcgctccatcccggcgatttcttccggctgcggccggatgccgagccagggcagaatgcggtcgatcaccgcccccggcagctcggcatggtcgaccagcagccacccggccggcgcgccggcgatcctgtccgccgccagagacagtgcccgcccgagaacggcggcaatgaacgtctcgatgtccatgccggcggcagcggtcggccgcatgcccaggctgaaggcccgacgcatcgggttgtgaaacgagagcgaccagccgggccgaaggcgcaggttcgagaccagaatctccagcggatcccgcatcacgaagaccttgcgcatccgaggcgcgaccgtctccagctcgccgaggcggtccaacccgatgcacgagaacttcaccataaaataccgggcctcgggcatcatcggacgcccgagcagggcaagcacaaggcgcagatcatcctgcctgacaccggccggaaccggcgtccagaacggccccatcagatcgagcagcgcttccggctcgtcggcgatctgcacgccgccgatcccgcccagcatgttggcgaccagggtcgacccgcagcgcgaggcatggaagatcccggccgtcagcggcaggctggtggccggagacggtccggcagccagagacggtccggccgtcagggacggatcatccagcgacaaatcccggaagagcagatcccgaaagggcgcatccgcatcccgcgcctgacgcagtgccgcacggaacgaccagcggccatcagccggccgggcggcggaccttaggcgcagacgccggccgtcgcgggtgatgagcgcccgctcgggcagctcccatccggcgatcaactcatattgcgggtggcgagaccttccgtaacctggctgccagccccctcggtctgatcatggatgggcacgaccgtcagccttggcgtcgaccagaccgccgacgtcatattgacactggcagaaagctcaccgtttcgatcggtcatcgccggctactccttaatgatgatgatttgtgcagacaatacacattgcgatcggcgcggtgaacgggcaagagcgtcgccgcccggagatgatgtgcctcagccattgccaccctcggcccgacagatgaactgcccgacgcgcaacccgcgcccgacggcatgcagcaggggcagcatggtttccagccgggacgcctctgtcgcatctgcgggccaggcctcgatcagccgccggatcttcggcaggtcgagcacctcgcgggcaagcggcgatgcctcgcagcgcgcgatctccgccatcatccagtcgcgccggatggtcatccggtggaaccagtcggcattttccagacccgtccggcgctcgtcgagcaccgcctgcggcagacgaccggccaggacccgccttgcaagccagcggtcgcggccccggtccagatactgccccgggggcagccccaggcagaaatcgaccagccggacatcggtgagcggatggcgccgatcggccggatcggcccacatatggccggaatgcgcgagcttcaggaaggtgttcttctcgatcagctcgattcgcatgtcggcgtcgcgagaggcggtgcaccgtggcgcatggcctgtaagacgtccctctgcgagccgttcgccgagtgccggggcaagggcgctgcgttcacgccaaagctccggccgtcccctgaggcgcttcacggcaagccgcagttcgggcggcagggccggcagcagcgcccatcccagaaattcccggagcggtgatttgccctggcgtgcccgcccggccagattcgatgccagagccccgaagtgcaggcgacgaagctgatcggccatcgcaagacgcccgtcccagctgagcgacagattgccgccctcgcccgtcagcaccacacgcgcccccagatcgcgcgccagatccggtgtcgggtgatagagcccgtccgagaacagccagctcatcggccagtcacggcgatggaaacgaccgcccggatcttcatccggccccgtcggctccggcgccaccacatgatggggcaccatgttcggatagagcggcggcaccagccgggcaccatcccactcatcctggatcagcccgggcacctcgggcaaagccaccatgggctgcggtcgcacggtcacggtatgcaggggcgccgggccccgcagccgggccgccgtcgtggccacggcggtggaatcgagcccggccgtcagatggcagagcagcggttcgtcaccggccggcagacgacaggcgaccgcctgttccagcagatggcgggccgcctcgacatagtcgtcatcgcgccggaaccggatccggcgggtgtgatcgggctgccagtaccgccagagccgcagacggccgtcggaccaggtgagcccatgccccggcggcagcatgtcgatatcggtgtgaacggtgcgattgggccggcgatgggcggcggcgaccagcgtcagccccagaatatccggatccagcccctggggaacggccgggtgggccagaagcgtatcgatccgggacgcgagcagaataccgtccgggcggcagcaatagaacagcggccgcccgcccatctggtcgatcgccgcaatcagctcccggcgcgccggatcccagcggatgaccgcaaaatcgcccacccaggcggcgggggcagcctctccctgacgggccaatgcggctgcggcaagggtgtctgcctccgttccggccggatggtcgagcatggcggcgagttcggcagcattgtagagggcaccgtcgaacaggctgacactgccatccggtcccggccggcatggcaggggccgcgggggccgcgacgacggtccggccgccccggtctggagcagcagggcgatgccgtcgtcatggtgccggcggatggtcagcccggatacggacaccgccgccgccgcccgccggtcgtcgatgacgccatagtctcgcccgacatgcgcgaacaggagattcacggcaccgttcccacctcgaatggatgtcgccaagagacggccgtctgtctcacggcctacctatccggtcggacagggctctgcaagccgggaacgatcggatgcgccgccggcgtcacgccgaagctctggcggaaccgggcgatgaagccgctgacgctggcatagccgaggtcgaaggcgatggcggtgaccgaggcgccctcggcgagcatttccagcgcgcgcatcatccgggcgcggtggcgccagtcggtgaagctgaggccggtttcgcgcggaaaccggcggctgagcgtgcgcggggtgatgcccgcccaggcggcccagccgtccaggctgcgtccgtcggccggatcttccaggatcgcctgtgcgatccgctgaaggcgcggctccgccggcatgggcaggccgaaatcttcggcgggaagccccctgatctcgtccaggatcagcccggtgatccgggcgcgcgccgcatccgtccgctcatcttcccagctcgcggcgcgcaggatcgcctcgcgcagcagggccggcacgcgcaccgtgcggggggtggacggaagctccgtgcagcgatcggggcggatataggcggtccacccggcgcccggcccgaagcttcgcccgccatgcaactgccagggcggcagccagatgccgtaaccggccggcaccagccaggcgccctgatcggtcagcacggtgacgaccccgcggctgcagccgatcatctggccgcggggatgacgatgggcctcggtgtcgaattcgcgcttcagctcaaccgtgaaggctgcgacctccgggccgtcgagggcatggccgatcgtctcgggtgcatgggacatggcgccatcctgctatcgattggcgccgatagattagcagcgccaggccagacggcgtagaacggatccatccgaatgcgggaggcaaaccccatgtccgacatcaccccgaccgatctcgaccagctctatgatccgccgtccgaggcgatccagcgcggcgtcatgccccatctgatcggcttccacgaagactatatcgcgcgcgccaccttcttctgcctggcgagcggccgcgaacacggcctcgacgcctcgccccggggtggtcctcccggcttcgtgaaggtgatcgacccgcagcatgtcgccttcgccgactggcccggcaacaaccggatcgaaaccctgcgcaacctggtcgaggacgaccgcctggccatgctgttcctgtttccggggctggaagtcttcctgcgcatcaacggccgcggccggatctctcgcgaggccacgcttctggcgcagctgacggaaggggcaaagacccccaaaaccgcgatcgtggtcgcaatcgacgaggtgctgttccactgcggcaaggccatcaaccgcgcccgcctctggcagccggacgcccgcatcgaccgcggcaccctgccctcggtcggccggatgaaagccgccatgaccggcggctcagacgccgatgccgggcgggtggatgcggaatatgagcgggcggtgaggaatgatctgtattgatcggcttgcggggtcaggaggccggccttacccactcaagggtagaaggagcgcctgaccatgcactctcagacacccatgcccgacagcagtgccgacggcgagcgccgcattgatctttcggtgcgcgacagcgaagcctttgttcgggctctcaccgacccgcagccgctcgaggatcgcctgtcggacaccatcggtcgataccgccggcagaccggcgtctgacacatacaaccgacgtttcggtcagatcgcaggcgacgacatcttgccggtcaccatcttgtcggtcactcccctgcatctgcccgaggaacctgctccgccacaaaccggatccgcccctccaccaccggcgccacctcgccgctgcgggccaggtggtcgatcacctggttggcggtgagttgcgaatccgacaggccgatcacggtccgggcggtggcgaaggcgccatagccgtcgccggcgccggccacgtaatcggtggtggcgagctggtagagccggtcggggtcgagcggctcaccgcccaccatcacttcctgaagccgggcgccgggcggctgggcgggatcgacggtcagggtcatgcccgagacctgcgggaagcggccggccagctcgtccagccctgagaggccgttttccagcgccttgtgcaactcggcgccggtcacttccagcttgagcgtccggttgccgaagggcagttccgagaggatgtcgcggcgggcgatgcgggtgccgggctcgtagatccggtcggcgcggatgccgccgccattgatcatcgccacctcggcccccaccgccgcacgcatcgcatcggtgatcagattgccgatcgccgcctcccgcccgcgcacggtggcccggcggctgtcgagggctgtggccagcgtcgccaccggctcgtccagcgcggcgcccaggctctgcccgtatcgggcgaccagggcggcgatgtcgggatcgggcgtcacctcacccgtgtcgacgatctcgaatcgcgggcgccagctcaggcggtcggcggtcttttcgatgtcgatgcgggtgacgaccacatgatcgccttccgatccgctttcggcgagggcgacgcggccgtcatggaagaccagcagatgttcgtcatggcccgacaggatcagatcggtgccgccgtcgcgcaccagacgcatgtcgatgtcgaggggcgtatgggccaccgcgaccacgaaatcggccccggcctcgcgcagctgccgggcggcggcacggccggcatccaggctggcgccgaagatgatggcgctgcgcctggccacgacccgggtcgattcggtggtgagcccgtagaagccgatgcggatgccgtcctgctcgacgattttggcgggcagcgtatgggccggctggctgccgtcgggctcgtggatgttggaggcaacgacgtcgaagcgggcctcggccatgcgggcgcggaagacctcggcgccgaaatcgaactcgtgattgcccggcaccatcacatcggggggcatgtggttcaggatgtcgatgatatgccgcccctgatcgaggccggagagcagcgagggcgagatggtgtcgccggcatggatgaagaaggccgggccttcctgccgcacccggtcgagcaccgccttgacccgggcaaagccgccgcggccgtccttctcgtccatccggtcgatgtcgttggtctggacgaagcggagggtgacggttccggccgctgccggcacggcggtggcggcaagcagaatggcggccgcgacggcggccagatggtggcgacgcagcgtcagcggcattgcccgacactcccttcggcgcagcgcgtggtgccgtcgacccagacggccccttccagatcggcatcataaagatcggcgccggtcagattggcgccggtgaaatcggcgccgcgcagatcggcgcggtagaaccgggcgcggcgcagatctgcgccggtgaaatccgcccgggcggccttggagcgggtgaaatcggcactttgcagatcggcctcggcgaagatcgccgcttcggccttgcccgagacgaatttcgcgccgcgcagatccgcgcccgagaaatcggtgccggtgacgtcggcgcgggtgaacgaggcatcgcgcagccggccgccggtcagcgacatgccctgcatcggccgcccgtcgaagaagcagccgacccagttcacccccggccggccgggatcgctgcaaccggcgcgggcgggaccggtatcggcggcgatcaccgcggcgagggccagcagggagacggtcaggctgcggcgcaaaaagctgcgagagtcggtctggcgggtcatcgggagcatttgcctcgtctggccgatccataacacggcatccgcaccaacatatcgcgccacgccacccccggacaggccgaagcgccggctgcgacgccgcgacaccgccggggccggcgcgaaaagggttggcgttcgcggctgacggggacaatctgtgcatcaaacaccggatgcggaggccccgataccggtgatcgacatctttccggagatccgtgccatggccctcgccgcccccgccccgtccgcccccgcccggcccgtcgccactgccgtcgacgacgctttcgtcgcggccctcgtgcagcttctcggcgaccgggtctccaccgctcaggcggtgcgcgaacagcatggccgcgacgagagctatcacgacgtcgaggcgcccgatgtggtggtcttccccgagaccaccgaagaggtggcggaagtggtgaagctctgcgccgcccatgccgtgccgatcatccccttcggcaccggcacctcgctggaaggcggcgttgccgccacccgcggcggggtgtgcatcgatgtcagccggatgaaccagatcctgcgggtatcgaccgacgatctggacgtcaccgtccaggccggcgtcacccgcaagcagctgaacgagcatttgaagaccacggggctgttcttcccgatcgaccccggcgccgatgcgtcgctgggcggcatggccgcgacccgcgcctcgggcaccaatgcggtgcgctatggcacgatgcgcgagaacgtgctgtcgctgaccgtggtgatgcccgacgggcggatcgtcaagaccgcacgccgcgcccgcaaatcctcggccggctatgatctcacccggctgttcgtgggctcggaaggcacgctttgcgtgatcacagaagtcacgcttcggctctatggcgtgcccgaggcgatctcggcggcggtctgcccgttcgagaccctggaaggtgccgtgcgcacggtgatccagaccatccagatgggcattccggtcgcccgcgtcgaactgctcgacgagctgtcggtcaaggcggtcaacgcctattccaagctcgacaacccggtgcagccgaccctgttcttcgaattccacggcaccgaggcgggtgtggtcgaacaggccgagatggtgcaggcgatcgctggcgagcatggcggcggcgatttccgtttcgcgacgctcgccgaagaccgcaacgccctctggcaggcccggcacaatgcctattacgcctcgctcaggctgaagcccggctccaagggctggccgaccgatgtctgcgtgccgatctcgcagctggccgatgcgatcctggagacccgcaaggatctggaaagctccagcctgatggcgccgatggtcggccatgtcggcgacggcaatttccatctggtcttcctggtcgaccccgagaaccccgacgatctgaaagaggcccagcgcctcaacgaccggctggtggagcgcgcgctcgcctttggcggcacctgcaccggcgagcatggcgtgggcctgggcaagcgcgacttcctgatcgccgaacatggcgaggcgatttcggtgatgcgccagctgaagcaggcgctggatccgcaggggatcatgaacccgggcaaggtgctgcgcccctgaaggtctgagtccggggaggatctgagcccgggaagggctcacccgaaggtttcccggcaaccactctgcaacgatgcccgcgcgccccggccgcgggcatcggcgtttccggggtgacgcgggtggtataccgggcctagactgcccgccatgccggcaccagaccggtagcttcgacaagacgatgacgtgtgaagaaaccgtcgggagacgaccgaagatgctcagcacccgttccggggcgcggccttcccgccgcagcctgctcaagaccatcggcctttgcggcgcggcgctcgccgccctcgcctcgggcctgcccggcggcgccgtcgcggcggaaaagaccaaggtgacggtcgcggccctcgccttcgtgtcctcctcgccgctgttcatcgccaaggaccgcggctattacgaagccgaagggctggatgtcgacatccagatcttccgcgccgcccagccggtggcggtggcgattgcctcgggcgatgccgatttcggcgtgaccgccttcaccgccggcttctacaacctggcgggcaagggcgcgctcaaggtcatcgccggccagtcggccgaaatcgccggccaggacggatcggcgatcctggtctccaacaaggcctgggacgagggcttccgctcggtcgacgacttccccggccacagcctggcgatgacccagaccggatcctccttccactacatgatcggccggatcgccgaggcccgcggcttcgacctctcgaaggtcgacctgaagccgctgcaggcggtgccgaacatgatcgcggcgctgaaatccggccaggtcgacgcgatgatcatcgtgccgcatatcgccaaggggctggtcgattcgggtgccgcgaagatgatcggccgggtggccgatatcgccccctatcagctgggcgggctgttcacctccacccgcaacgtcagcgaacatcgcgacatggtggagcggttcgtgcgcgcctatgtgaaggcggcggccgactacaacgccaccctcaaccagaacgacgccaagggcgaacgggtctatgggcccgacacccagccggtggtcgacatcatcaacaaatatgtctatcccgaaaagccgaacgatgccggcgtgaaggcgggtgcgatgtatatcgaaccccagggccggttcgatgccgccgacatcgccgatcagctgcgctggtacaagcagcacgacctggtcgatgccgatgtcgaggccgcaagcttcgtcgacaccagcttcgtgcccggcggcttctcggttcaggcgaagtgacgacccgacgatgcgcctgatcctgaaggccgtctctcatgcctatgacggcctgcacgccctcggccccgtcgatcttacggtcggcgcgggccgcatcgtcgccgtggtcggcccgtcgggctgcggcaagtccaccctgctcggcatcgccggcgggctgatccggccgacatccggcgaagtgctgtcggcgggggcggcgcccgaaggctgcctgaacccgctgacctatgtcttccaggatttcgccctgctgccctggcggacggtggcgaagaacgtcgccctgccgctggaaggccgtgggctcggcgcggcagaggtccgcgcacgcgtggccgatgccctggcgcgcacggggcttgccgacttcgccggcgccgtgccgcgccagctgtcgggcggcatgcgccagcgggtcggcatcgcccgggcgctggcggtctcacccgccgtgctgctgatggacgaaccgctctcggcactggatgcccagacccgcgagctgttgatcgaggatcttgtcgccctgcacggccgggcgccgttcagcgcgctctatgtcacccacaacctgatcgaggccgtgcgcctcgcccacgaggtggtggtgctctcccgccggccgggacggatccgcgaggtggtgcagatcgacacgccgctcgatgagcgtgccgcggacggcgccggcatggccgccctggccgaccggctctggcggtcgatccgcgacgaggccgccaccgccgatcgtgaggtgcagcatggctgaccagcctcttcggaccacgccccaggacgacacgccgcgcccggtgccctatcgcggcggcggtttcgcgccgcgccggatgccgctggtcaccggcctgttcttcgccctgctcttcggcctctgggcactgggatcggcccggggctggatcggaccgctgaccctgccgccgccgggcgatgtgctggccgccctcgcccggctgatcgagaccggcgatctctggcgccatctttccgcctcgctgatgcgcctcggcctgggctgggcgctgggggccgccttgggcgtggcggtcgggctgatggtcgggctgttctcgctggcccgcgccaccggcctgccgctggtgacggcgctgttccccatccccaagatcgcgctgctgccgctgttcatcatctggttcggcatcggcgagccgtcgaaggttgcgaccatcgccttcggcgtgttcttcccgaccgtgatcaacaccgccggcggcgtggccggcgtgccgcgcagcctgatctccatgggccagagcttcggcctgtcgtcctggcggatcgccacccgcatcgtgctgccgggcgccctgcccgccatcctgaccggtttcagggtctcggcctcgatcggcatcatcctgctggtggcggccgagatgatcggcgccgaatacgggctgggcgcgctggtgctgaatgccggcaatctgatgcggctggatctgctgatcgcgggcgtggtggtgctgtcggccctgggcctggtggtcgccttcctgctcggcctggtcgagaaacgcctgctgcgctggcgctgagccgggtttcatgctgggatcggcgccatgagcacgaccgataacgacgttccgacccgcggcctggtccacgcctttgccctggatggcaggggcggcggccggccgctctcccccgcccagaccgcggcggcgctgcgcgaccgcagcgccggccagacggtcgatgcccccgatctctggctgcatgtcgaccggatggatccaggcgtgcaggactggctcgatctcgcgggcgtgccgccgcatgcggccgaagccctgctcgccgaagagacccggccccgggccgatcgcttcgccgacgggctggtggtcaatctgcgcgggctgaacgtcaacccgggcatggaggcgtcggatctgatttcggtccgcgcctggacggtggcggggatgaccatcaccacccgccgctacccgctgcgctcaacccgcgaaatggccgaggcgctgaccgccggcagcggcggcccgcgggattcgggcggagtgatcgccgatctggccgaccggctggtcggccggctccggcccgaggtcgaccggctggaagacctgatcgacgatctggaagacgaggcgctggccggtgccgccgacgcccgcccgcgcgagggcatccgcaaggcgcgcgccgcgcttgccgaactcaggcgcgagaccatcgccttccgccgctatatggcgccccagcgcgaggcgctgatgcggctggccgggctcgacccgtcccccttcggccatgtcgaccggctggaactgcgcgagaccgccgaccagctgacccggatggtcgaggatctggacgccatccgcgaacgcaccctgctcgcccagagcgaatgggaagcgcgcatcgccgagcgcaccgaccgcacggtctatctgctgaccatcctgtcgtcggtgatgctgcctttgggcttcatcaccgggcttctgggcgtcaacgtcgccggcatccccggcgccgacgacccggccgccttcctgctgctgtgcctggcgctgggcctgctggtggcggtgcagttcgtcctgtaccggcggctgcggtggatctgatacccggatcgcgccacttacatggggattttcccaagatcttcgcaaacttcctcggccagatctctcaaacgtctcgctgtacactgcggaaacgcatcgatcataagatttaaacgtcgatgtaaattactgacgtttttactcttaaaaatctcacatcttgtccgttcgggatacatttgtccggcatccccttctttcgagtgatgtgggccatagagtcctattccgtggcagaataggaatttgtcaaacacacgcagtccaaggaggggttaaatttatgatctgatgctttttttgacagagcagacgaattttcatcccagaatttcgaaatattctcgtaacattctttcatattactttgatttctccttaaaactgcagaattcacaaatttgtcaaacatcgtccagtcttctggacgcaaaaaccatgttaatttagagtatgctgaatttatctttctgttttcaattctattcttatcagagaattcgcatagaaatttagcacgctcagtaaattttctctccaaaatgcgtcgcatacaattactgtttaatttatcgacaagtctgcatctagcatcaccttcaatttttatatttctactaatagaatattcttttaatatatattttaatgtatccgtgtcaatacaaccaatgtcgttatcacttctatcgccattcttagaaagaacacccgtcaatctcaagataacataatcggcagtaatccatcccctataggcgtcgataaccgccattaaactcatttcttttaatacgcttttttcgtcatcaatagatactccagacatctcgctctctccgtcaaaaatcttttagagataggtcgacgccacggccggctgttcgctcagcgcatgggccatgtattccagcgcgcgacgcagatcggcgcggctggtcgggccacccaggcagaggcggaccgcttcgggcggggtgacgccgaccgcgaaggcgtcgctcgccaccacaccgatgccggtggagcgcatctgacctatgaaggccgaacgggtccagcccgcgggcagcggcacccagagattgaagctggccgggtcggttcggaagctgtcgggcgccagaacctcggcggcgagctgctggcgggcggcggtctcggcacggatgaagcgcagcagggcgtcggcggtgccgtcctcaatccagcgggtggcaagggccacggtcaccggcgaggccatgaccgtggccgtgcgcaccgcagccgtgaagggccagccggcccgggcgctgggcgccaccacataggccgcccgcagcccggcgccgatgcattttgccaaccccgccacatgccaggtcagatccggcgccagcgccgcgaagggggccgggccctgggcggggatgaagccataggcatcgtcctcgacgatcggcacgccgaaccgccgggcgatggtgacgatctcctcgcgccggcgctgcgggatggtcagcgtggtcgggttctgcagggtcgggttcaggtagagcgccttgggcgccagacgccggcaggcatctgccagggcatcggggtcgatgccgtcgtcgtccatcggcaggccggccagtttcagccccagctgggcggcgatcgaccgcacgcccggataggtgatctcttcggccagcaccacatcgccggccgaggccagcacgcccagtatccccatcagggccgcatgggcgccgggggtgaccatcagccgttcctgggccggcaccagaccgcgacggccgagccagatggaagcggcatccttgtcggcaggggcgccgccgaaatcctgatagcgcagcagcgccaccagatcccggcccaccgcttccagccccgcctgcatgcgggcgatcagcgccggatcgtcgggttcgggcggcaggttcatcgtcaggtcgacgacgtcggcgcgtcggggctggccacgtgccacggtttcgcgatccgggcgcggcagggcccggacataggtgccctgtccgacccgcgattcgaccagcccgcggcgatgggcttcggaatagccccgggcgacggtggtgaaatcgatgcccagccgctccgccagccggcgctgcggcggcagccggtcgcccaccgacagccggccggaccgaagatccgcctcgatcacgtcggcgatcgccagatagcggggtctgtcactggcggacaggtcgggcatccactccgtcatgcggtcaccgggtctcgtctgaaggcaattgacggtatcttgttgcacgccctgaggcggggcgcaatcgcgggcagcggcggctttgtgccgcagatcccggcagtgaccggattgactggatttccgcccggccgacgtccatccggatccgacagtttttatgcggataacttgggcaaacgcgcccatgcacgaaatttaagctcaattcataggcagaacgaccattccataggcgattccgacccggcgaccatgctgattgactgtatatatgactgcaaattgactgcatctgattacatcatgaacaggcggtcgcatggcatgggcgttgcacttcccgagaccccgagagccgcggcagaggcgccgcggaccggcaccatcggagagacaacgatgcccgtggtcaccaagcccgcccatcagaccggcgacttcctggtcaattacgaagagaaggtgttcgaggacgtgaaggcccagccgggagagaaggcgctggtcaccttccacaccgtcgccttcgaaggctcgatcggccttgtgaacctgctgcaggcgacccggttgctgcgcaagggcttcgagaccaccgtgctgctctatgggcccggcgtgacgctgggcgtgcagcgcggcttccccaagctcggcgacgaggctttccccggccatctggcgatgaacaaccagatcgtcaaattcatggaggaaggcggcaaggtctatgcctgccgtttcgcgcttcaggcgctttacggccatggcgagccgtcgctgatcccggggatcacgcccatcaacccgctggacgtgctcgacctggtgctgctgcaccgcaaggacaacgccttcatcctcgacacctggacgctctgatcactcgtcccccgctcaagagccccccactcacgagccagagacgcgaggacgcgatgaccggatcccgtgccacacccgccaccatccgcgccgctgcggtccagatcgctcccgatctggacacggcggccgccacgctggagcgcgtcctcgccgccgccgccgaggcggcggcaagaggcgcacagctggtggtcttccccgaaaccttcattccctggtacccgtatttttcgttcgtgcatccaccagttgcaaccggtgccgaacatctccggctctacgaccaggcggtgaccgtgcccggcccggtgacggccgccctcgccgaagcagcgcggcgccatgccatggtgatggtggtgggcgtcaacgagcgcgaccacggctcgctctacaatacccagctggtcttcgatgccgacggcacgctgctgctccgccgccgcaagatcacccccaccttccacgagcggatgatctggggccagggcgacggcgccgggctgaaggtggtggaaacggccgccggccggctgggggcgctggcctgctgggagcactacaacccgctcgcccgctatgcgctgatggcggcgcatgaggagatccacgccgcccagttccccggcgcgctggtcgggccgatcttcgccgagcagatcgaggtcaccatccgccaccacgcgctggaaagcggctgtttcgtggtcaatgccaccggctggctgacgccggaacagaaggcccgcatcacccccgaccccgccctgcatggcgcattgtcgggcggctgcatgaccgcgatcgtctcgcccgaaggccggcatctggtgccgccgctgaccacgggcgaaggcatcctggtcgccgatctcgacatgggcctgatcctgaagcgcaagcggatgatggattcggtgggccattacgcccggccggaactgctgtcgctgcgcctcgacgaccgcccggcggtgccgatgcatcgggccgccgccccgtccgacaccctcatccccgggagacgccgcgatgtcagagatcctgcaggcgccgatgccgacccgtccgccgaccgcggagacgctgatcaacgagctgcaatccttcggcgccaggctggctgacgcagccggacccgcggtcgaccgcaagggcggcgccggcccgtcggatcataccgcccttaccatcggcgagacgacggtgatggtgccgatccacaccggcgcggccaaggccagcccctatgtgctggaacggcccgatacggccggccggtcccgggtgttccgcgacggccgggcgctcggcgaggtctcgttcccgcgccggccgcgtttctacgacaggatgaccgaagacggcgtgccctattggaagatcgccacgcttcacggccgcgacgtgctggcgaccaccgtgctgcaatcctgcgtgcgctatgtcagccgggccaagacctgccagttctgtgccatcggccagtcgctggccgccggccgcaccgtggagcgcaagaccccggcacagctggccgaggtcgcccgggcagcggtggaactggatggcgtccgccacatggtgatgaccaccggcaccccgcccggcaaggatcgcggcgctgccatcctggcggaaagcgttgcggcggtgaaggcggcggtggatctgccggtgcaggtgcagtgcgagccgcccgacgacgatgcctggttccgccgcctgaaagaggccggcgccgatggcctgggcatgcatctggaggcggtgaccgaaccggtgcgggcgcggatcatgcccggcaaggcccaggtgccggtcagccgctatcttgaggcattcgcggcggcggtgccggtcttcggccgcggccaggtttccacctacatcctggccgggctgggcgacggggtggacgacattctggcgctctgccggcagctggtcgcgatcggcgtctaccccttcgtggtgcccttcgtgccgatttcgggcacaccgctcgccggtcatccggggcccgatgccgccttcatgcatgcggtgctggacccgctcgccgccatgctggccggggccgggctggcggccgacgcggtcaaggcgggctgtgcccgctgtggcgcctgctcggcgctttcgacctatgagcgccgccgggcaggccgcccggatgccatcgaacgcgccgcccccctgccggccgaggtgctgccatgatgccggaaccgcttcatctcttcccgccatcctccccctttctgcccgcgagcttccagatcaagctggcggtggagccctgggaacgcgccgcggctgcccggctgcgccggcaggtgttctgcaccgaacagcgcctgtttgccggcgatgacggcgatgcgatcgaccgggtggcgctgacgctggtcgcggtgtcgctgctgggcgtcgccccgggcgatgtggtcggcacggtgcggatccacgaggccgaaccgggcctgtggtggggatcgcggctggcggtcgaccgcgcccatcgccggatcggcgccctgggatcgggcctgatccggcttgcagtctccaccgcacgcgcccgcggctgcagccgttttctggcccatgtccaggcggcgaacgcaccgctcttccaccggctgcactggcgaagcctggccgaaatcgaccttcacggccacccccatcaccacatggaagccgatctcgatttctatccgccggcccgggcgcccgagaccgggttcatgacgctgcggagggcggcatgaccgcgctcgacgccctggcggcagagctggcgcgggcgccggggctggcggccaaggccgatatcgcggcggtgacccgccgtcttggcctgaccggggccggcggtgccgcggtgcccgtgggcgacgactgtgccgccattcccgatggcgacggccatctgctgttcgcgatcgaaggcttcatgaaccgcttcgtggccgccgatccctggttcgccggctggtgcggggtgatggtcaacctgtcggacatcgccgccatgggcgggcggccgattgcggtggtcgatgcgctctggtcgcccggcgacggcaccgcggccgaaattctcgacgggctccgggcggcggcgcgctgctatggcgtgccggtggtcggcggccacagcaatctgtcgacgccacaaccgcaactggccgtggccgtgctgggccgggcagaacgcctgctgaccagcgccgatgcccggccgggggaccggcttgtgatggcggtggatctgcgcggcgcctggcgcccgcccttcgacaactggcaggcggcgctgggggcaccggccgaccggctgcgcggcgatctggccctgctgcccgcgatcgccgaagccgggctcgcccgcgccgccaaggatatcagccaggcgggtgtggtggggacggcggcgatgctggccgaatgctcgggcgtcgggatcacgatcgacgtcaccgccatccccgcaccgcccgacaccgatcccgcccgctggctgaaggcgtttcccagcttcggctatctgctggcggtcgccccggaccacgaggccgctgtgatccgccgattcaccgatcgcgacatcgccgccgccacgatcggccatatccatgccggctccgtggtctcgatcaccgacggccgatcgaccgcggcggtctgcgaccccggcgccttccccctgctcggctgcgcgccacacggcatgcctgccgtcacccggcctgtccgcacccttatgggggaggccgtaccgtgatctccgccgaccggccgctgcgcatcgcgctgctcacccattcgaccaacccgcgcggcggggtggtccatgcgctggaactggccgatgccctggtccggctggggcacgaggcggtggtgcatgcgcccgatcccgacgggcgcggcttctttcgcgacacgctggccggcacccggtcggttccggtgacggcaccggcggggcctggtctggcggcgctggtccaaagccggatcgccggctatctggcgtatttcgaggatccggccgcccgcgatttcgacatctttcacgcccaggacggcatctcgggcaatgcgctggtgacgctcagggatcgcggcctgatcggccgggcgatgcggaccgtccatcatgtcgaccgcttcggcgacgaccgggtcgatgcgctggaagcgcgctcgatccgcggcgccgacgagctgttcgtggtctccagggtctgggcggacgagctggcccggcgtttcggccggcaggcgacggtggtcggcaacggcgtcgacatgacccgcttctccccggatgccgacgggcgtgaggacgggctgcggcagcgcttcggtctgggcgccggcccggttttcctctcggtcggcggcatcgaagcacgcaagaacagcatcgccatcctgcaggccttcgctcaggtccgacggctgaaaccgcgggcacggctggtgatcgcgggcggcgcctcggtgctggatcacgacagctatcgcgcccggttcgaggcggcacgccatgcctgtcgcctgcccgcaaatgcggtggtggtgaccggccggctggatcatgccgagatgccggcgctctaccggatcgccgacacgctggtcttcccctcgctcaacgaaggcttcggcctggcggtgatcgaggccatggccgccggcctgccggtggtgaccgcgaccatcccgcccttcaccgaacatctggccgccgacgaggcggtctggtgcgacccgcattcggtcgcctccatcgccgacgcgatgctggtctcgctggtcgagccgctgcgcagccggctgatcgccggcggctatcgggtcgccgcccgtcacgactggcgccgcaccgccatggcccatctcgcccaatggcgcctgctgcacgaaaccgccaccccgagggggatgccatgcccgagatgaccttcaccatccgctggcccgacggcgccgtggagcgctgctattcgccctcgctggtgatccgcgaccatttcgccgccggtgccgactatgcccttgccgatttccgcgcccgcgcccgcaccgccctgatcgaggcgagcgaccgcgtgcaggcccgctatggctttccctgttcgcgcgcgatgggccagctcgaccggatcgaggccggctgcgcgcgctttgccaccaccgccggcgcgcgggtgcgcgtcgagcggttcgacgatcctgcggagtgacccggatgacgcatctctctcccgacccccacctctcgacgccccgccatctggaggtcgccatcatcggcggcggccaggccgggctgaccctgtcctggcatctcaaggcccggggcatcgaccatctggtcttcgaaaagaagaccgccatgcatgcctggcgcgaccagcgctgggacagtttctgcctggtcacgcccaattggcaatgcgaccttcccggccatccttacgacggcgacgaccccgacggcttcatgaagaaggacgagatcctggactggctccgccgcttccgcgacaagctggacccgccgcttctggagaacacggccgtgctgaaggtgtcgcggcgggccgggggcggcttcaccatcgcaagctcggccggcagcttcaccgccgaccaggtggtcgccgcctcgggcggctatcatgtgccgatcgtgccgcgcttcgccgaacgcctgcccgccgacatccgccagatccattcggccgattaccgcagcccccaaagtctgcccgaaggcgcggtgctggtggtcggctccggccagtccggcgcccagatcgccgaggatctgcatctggccggccgcaaggtccatctggcggtgggcgatgcgccgcgctgcgcccggttctatcgcggccgcgatgtcgtcacctggcttgcggagatgggctattacgacatgccggtcgaacgccatccgctgaaagagggcgtgcgcgacaacaccaatcactatgtcaccggccgcgacggcggccgcgacatcgatctcaggcgcttcgcgctggaaggcatggcgctttacggcctgctccaggatctggagggcacccggctgcgcttcgcccccacgctccgcgaggcgctggatgcggccgaccgggtctataacggcatcaatgcctcgatcgatcgccacatcgccgaacacagcatcgatgcgccgccgccctcggtctacgcgccggtctgggtgccggagaccgagcccgaaagcctggatctggaggcggccgggatcggcacgatcatctggtgcatcggcttccggccggatttccactggctcgacgcgccggtgttcaacggcgccggccacccggtgcatcaccgtggcgtcaccgccgaaccgggggtgtatttcctgggcctgccctggctgcacagctggggatcgggccggttctcaggcatcgatcgcgacgcgcgctatctggcagaccgcatcacggccggcacggcggaagtgcgccgcgccgggtgaggcgccggcggtcacggccggcggtagaggatcatgccggcatggtagagcacgccgtcgacgaaatcgccatcggcggtgaagccggtgtcgtcgacatagtcgatatgatcgccggtgatcgtgtagcggccctgataggccgcttcacggctaccgcgcgcctcgacatagcggccgtcggcgcgcagttcgtggcggatgcggccgtcttcggtcacccacatgccgatgtaagggtgtggatcggttgcggtcacggatgtcgtctcccctgcaagggcggtggaggtcagcagcagcaggccggcggcgataaggcggcgcatcggtcctctcctgatcaatgcgggctggcggtcgggcggatgacgatctcgctggtgtcgacgtcatcgggctgggcaatggcgaagcggatcgcgcgggcgatcgcttcgggcgggatcgccaccgcccggaaggtggccatcgcgtcgcgggcggtggtatcggtaatggtctccgccagttccgaggtcaccacgccgggcgagatcaccgtcacccgcagccggtcggtttcctgcctgaggccgtcggaaatcgcccgcaccgcatatttggtcgcacagtagaccgcggcggtcgggctgacggcatggccgccgatcgacgagacgttgatcacctggccgaagccctgcgccgtcatcaccggcagcacggcggcgatgccgtggagcacgccgcggatgttcacgtcgatcatccggtcccattcgtcgagcttgagcgaggcgagcggcgaaagcggcatcacgccggcattgttcacgatcacgtcgatccggccgaattcctcgcgggcggcgacggcgaagccggcgatgtcgtcgcggtcggtgacgtccagcgtccggacgcggatcgtaccgcccgcttccgtcacgtcttgggcgaggcgctgcaagcggtcgagccggcgggcgccggcgaccacgatcgcgccggcttcggccagcagccgggcggtggtctcgccgatgccgctgctggcgccggtgaccaggacaaccttgccggcgatgccgtcgatgggggcggtcgtcatatgcgtcatctcctgaggctggccccgaaggccgttggtcctgaaagagagatgacatggcaggcggccggatataatccggcaggaacgaccaggacttttaagcccgactaaataattgtgccggcggcacgcagcgcatcgatgaaggcgcgcatcgccggtggcatccggcgctgccgcggatagcacaggaagaagccgggatagggcgcacaccagggctccagcatcgtgaccagccggccatcggcaagatacggccccgcctcctcgtcggtcaggaaggcgatgccgatgccggcaaggcaggcatccagcatcagccgccggtcgtccaggatcagcggcccttcgaccgagaccgcgaaccagccatcggcccggtgaaattcccagtcatagggcaggctgcgcccgctccaccgccagcggatgcagtcgaacccgatcagtgcctccggggtctcgggccggccgtgacgggcgacgaaatccggtgtggccaccggcatctggcgatgatcaccaccgagcctgaccgcgatcatatccttctccaccacctcgcccgggcggatggcgaggtcgaaaccgccggcgaccggatcgaccacagcatcatccaccgtcaggtcgatcaccacatcgggatgcgcggcgtggaaagcagccagcatcggcaggatccgccgttccgccgccacctgtgccgcatgtacccgtaccgttccggcgatgcgtccgcccgcgcgggcggcacccgagacggcatcgccgatctcggctatggccgggcgcaggcgttccagcagggctgccccggcaggcgtggtggcgacgctgcgggtggtgcggttcagaagctgcacgcccagccggtcttccaacgcccggatggtctggctgagagccgaaggggtgacgcccagcttctcggcggcacggctgaagcccgcctgttctgccaccgcgacgaaggcgacgagctgggcatattccgccccctgaacggtcggtgtcatgacgctgtactccggacgggattgccggcacgccgcagatgctctccaatgaccggtcatgaactgcgcgacagacgcacccggaggaacgcccgatgaccgacaccatccgccttacccgcgacggcccgatcgccaccatcaccctcgaccggccgccggtcaatgcgctgggtgcagccgagctcgaccggctgatcgcgctggtggtcgaggtcgatgccgatcaggacatccgggcggtggtgctgaccggcgccggacgctgcttctcggccgggctcgacctcggccaggagctggatgcgatcgaggccgagcgccccggcccgtcatcgcggggcgtggcgctctatcaggcgctgaccggccggcgcacgccctggatcgccgccatcaatggcccggccctgggcgcggggctcggcatcgcgatctgcgcggatgtgatcctggcgtcggagaccgccaccatcggcctgcccgaaatcgatgtcggcatgctgggtggcgcccgtcacgccatgcgcctgctgggccattcgaccgtcgcccggctgctgctgaccggccggccgatgccggcggcagagctggcgcggcgcggcgcgatcgagccggtgctggcacccgatgctctgctgccggcagcccggaccctcgccaccgaaatcgccgccaaggacccggtggcggtcgcccatgccctcgcctgcctgtcggaggtggaggatctgccgctggtcgagggctatgcggccgagatgcgacatgtggcggaactggcccgtaccgaggccgcacaggcggcgatgcggcggttcctgaagcgcgaggcctagagcagggtcagacattcacgccttttttcaaagatcacaccggttccttcaagaccgacgccacccccactgcctatcgttcttgtccaagatacgattcttcaacaaaaacatagcgccagttccaaccggcgcagggagggctcatgtctaagattgagaaggtgaccgtgctcggcgccggcgtgctcggcgcacagattgcatggcataccgcttataagggcaaaagcgtcgtcgtctacgacatcctcgctgaggccctggagcgctgcaggagcgctcacgagcagtatgcggaaatctacgggaaggacgttggcgccagcgcagccgatattgccgctacccgcagccgcctgcgctactcggccgaccttgcggacgcggtgggaaaggccgacctggtgatcgaggccgtccccgaagtgccggccatcaaaacggacgtctatcagaagatggcgccgctgctgcagccacacacgctgattgccacgaattcatccaccctcctggcacgcgatttcgctgccgcgaccggccgtcccgacaagtactgcgcgatgcactacgccaacctgatctggatcatgaacgtgatcgaggtcatggctcacccgcagacaagcagggagacgctgcgcgaggcaaccaggttcgccatcgagaccggtatggtgccgatccccgtccggaaggaacagaacggctatgtgctcaacacctggttcgtgccgctgatcactgcggctcaaacgctggtgaccaatggcatttccacgcctgaggacgtcgatcgcacctacctgaaggtcaatgcgggcgcgagcatgggacctatggctctgatcgacatggtcggcatgaaaaccttcttcgacgtcctgtcctattggggacaagcgaacagggatcagcagatgctggataatgctgcctacgtgaaggcgcacttcctggacaagggattgctgggcacggggacaggcgaaggctactacaagtatcccaatccggctttccggcagaaggactttctggccgtgcccgacctgtcgaaggtcgatgacatcgtcgcgcagatgatgccgatcgtgtgaagccggcccgttgctcccgggtgcggggctgtaccagttcacatcggcgatcgggcgcgcgccgacggcgcggccctctcccctgtgcagcttgtcgatgccgacgtgcaagctgttccggccggtcgccggatgcgtcataagatgctgcttatccaaggtacaccccctcgcggccgacgtcgttttcctcggcacagatccgtcgcgacctgtggcggaaacgtggggcgagcactcaaaaccggatgcatttcagacggcggttcgaaccgccgctcgacttgaaatcaagcaggcccggccccattcagagggtattgatatctaagggtcgagagggtgatgttaacctgcggtgccggtgcggtgatgctcgacgggtcttgagcgggcccgctccgaccgtgcgtgaaaggttctctcatgccgcatgtgatacgacccgaggaacttccgctgtgggtacccggagaggtgctgctttcgagtgacggtcgtgattggagagatatctacacacgtacctaccgctacggatgccttgatgtggaggttcccgcgctcacggactttatgctcgtgtcctatagaaagggcagcacccgggtcgatcgacggttcgagggacgctggaaagaggcgcagtgccacccgggcgacttctctctgttgacccgctcccaaccatcgcactggcgttgggtggcaccggtcgatgtcacgcatgtttacgtgtccggtgatctggttacacgcctggcggccgaggtgttcgaacggccgatggtcgaagtgcggctgaacgatttgctccaggcgcaggatgccgtggtcaccggtatcgtgaccgcgatcatcaatgaaatcggcgatcccgccacgggcggcggattgtatatcgatgcgctgggtgtccagctcgttgttcacctgttgcggcactatgcatcggttgaacccatcgccacctctgagcgcagccagttcgcacctgcattgcgtcggcgcctcatcggttatatagaggcgcgcctggatcagaacctgaccctcaaggacctcgcggatgtcgcgaatatgggtgtgtggaatttctccaggcatttccgggcctcgttccagacgtcgccccatcggtatattgtcgagcgcaggcttgagcgagcccggacgctgctgagccaggatcgcttgccggtcaaggcggtggctttcatgtgcggcttctccgatcaggcacatctgacgcgcgcgatgcgggcgagaatgggatgcaccccggccgcgcttcgcaagggcgcctcggctcaagagatctgaacactctcacgctttcagaccgcgtctttgtcctggcgcggcgcgggtcttcttgtctgtgctttacgaagctgatcggggaaacgtaactgcctgcgaggcgcaggccactcacccgattattcaaaacatcccacagtttctttcaagatcgccacatgtgggcgctgctagtgttccccatagcttgatgaccttgcgactgcggattgaccgcgattgcaaggccagggaggcaagctacaggagaagacataatgagcactggtctggacatcaccgtcccgaccaccgaggcgacgcctttcacaaggctcgacgcggtggtcattggcgccggcatcaccggcatgtaccaattgtacaagatgcgcgaactgggcctgaacgtccgcgcttatgaaacgggctcgggcgtcggcggaacgtggtactggaaccgctatcccggcgcgcgcgtggattcgcaggcggaaatctacaattactggatttccgaagaactctacaaggcctggaagccgagcgaacgctttcctgcgcagcccgagaccgaggcgtggctcaattttgtcgcggatcagctcgacctgagaaaggacatccagctcaatacacgcatcgtgtctgcccactaccaggaggacacgggccgctgggacgtgcgaaccgccgatggggagcatatcgacacccggtttctgctgacatgctgcggaccgctgtcagcgccgctgatcaatcgtttccccggacaggaaagcttccgtggcgaggttcatcacaccggcctgtggccaaaggccggtgtcgacgtgaagggcaagcgtgtcgccgtggtcggcacgggcgctacgggcatccaggtgattcagtccatggcccccgaagttgctttgctgaaggtcttcgtgcgcaccccgcaatacatggtgccgttgaagaatccaaaatacagtcaggccgattgggatcactggaccagccggttccacgaaacgaagcagcgtgtgcgctcaacattcgcaggtttcgatttcgacttcgcgaacaagccctgggcggagctgacgccatccgagcgcacccggatcctggagaaattctgggcagagggctcgctctccatgtggcttgcgacgttcccggagatcttcttcgatgagaagatcggggaggttgtttccgaattcgtgcgcgaaaagatgcgtgagcggcttcggcacgacccggatctctgccgcgttctgatccccacccgtcacaccttcgggacgcatcgtgtgccactcgaaaacggctatctggaggtctatctgcgggacaatgtcgaggccgtcgattgccgcgcgtcgcctatcgagcgcattgtccccgaagggatccagaccgccgacggcaggatccacgacgtcgatgtgatcgtactcgcggttggctacgacgccggtacgggcgggcttgccaggatcgacattcgcggccgcggcgggcgatcgttgaaggagttgtggcagaaggacatccgcaccgccatgggctttcaggtccacggctatccgaacctgttcatgaccacggcgccgctcgccccttcggcagccctgtgcaacgtgccgacatgcgcccagcaacaggtcgactggattgtgggttgtgtcgactatgcgcgccgcaacggaaagaaggtcatcgaagcgacgaaggaattcgaggacgcgtgggtcaggcatcacgacgagctggcgagcgcgacccttctttcaaaaaccaactcctggtacatgggcgcgaatgtcgagggcaaaccgcgccggctcgtggcttatgcgggtggcgtgggcgcctataacagccagtgtgacgaggaggccgccaaaggctatcccggcttcgcgatgcgctgatcctgaaaacagcgagagacattcaaatgcgcaataatccctattatggacccgaaggccacggcccctacgagatgatcggaattggtgatcttgatctcgaggaaggcgggcggatccccgactgccagcttgcggttgcgacgcatggtaaactcaacgcggcaaaggacaacgcaatccttgtgccgacctggtactccggcaccagcaagatcatggagcaggtctatatcggcgacggccgagcgctggatccgtcgaaatacttcatcatcgtcgtcaaccagatcggcaacggcctgtcgacgtcgccgcacaacagcacgggcgcattggccggccccggcttcccgaaggttcgcatcggagacgacgtgcgcgcccagcatcaactgttgaccgagacatacgggttggatcgcctcgcgctggtcgtcggcggctcgatgggcgcacaacagacctacgaatgggccgtgcgctatccagaattcgttcagcgggctgctccgatcgcgggaacggcgaaattcaccgagcacgacatccttctgctggatacgctggctgaagcgatcacctcggatccgggattccgtgacgggagctacgcctcaccggctgatgtcgctgcaggcctgaagcgacatgcgaaaggctggacgctctgcgggtggagcgatgcgttcttccgcgccgggcggcaccgagcctttggcttcgagaccgtgcgggacttcgcggataatttcatggtgggctatttcgcccccatggatccgaacgccctcctgtcgatgtcatggaaggcccagaacgccgacgtcagccgccacaccggcggggacctcgcggcggcgctcgggcgcattaaggcgaagacctttgtcatgcccatcagccatgacgtgatcttcccggttgcggactgcgcggcggaacaggcgttgatatcgggaagctcgctgcgtccgctggtgtcgattgatggccatctcggtctgtttggcgccgatcctgaactgttggcgcaagtcgacgccaacctgaaggaactcatggaaacgtcggtggattgatcccgccgcctcacccgccaggccacgggtttgcgcatcgccgtcgaagcagcccgtgcccgtcgcgccatcgacgccatcacgccggccgacgcctgcggctgtttcacggcgacgggctatgaatcagaatgatggcactccgatctggtttcgaaaggcgatgcgcatcacccggccgcgccagaagggcaggatgcggccgcccgcggcgcgggagatggtgaaagccatcggcagcatgacctccccgaccagctggtagtcttcgcgggtcacatgctcgcccgagccgtgataaggggtggtgaggtcgccatcctcttcggccgcgaagctggcgaggctgccatcggggcggaagctggcgacgagcgcggccgtcaggccgccatggctgaccaccgcccgggcatggctgtcgtcgatcgcctgccatgtcactggcccgccgggcagcagggccatggggtagagcgggctttccagcagccagcgcctgagcgaaatccggtcgagctcgggcgagccggtttcgtcgaccacggtgacgagacccaggatccgggccttcatctccatccggccgtcggcgaaagcatcccaggcgcgggcatgaatgccgggcaggatcggcgtgcgggcggcgaaggcaagcgccggcacccccaccgccacggtctggctggcggtggtgggggcgaacccttcggtgcgcggccggcggaaatcgcccgccatctccatctccaccagccgcacgccgacgggcgggccgtcggggaaggtgaagcggagataggcccggaccggcaccggcagggccgccagcgccgcgctatcgggatccggcggcatggcggcccgtgccgccacccgcacccgttcgacatgggcggcaatctccgccccggtccgccagctgccgatcaggaccgcgatcaggccggccaccaccatgccgccggccagaagggccgcggttcgccaggttctgcgcatgaaatctcccttccccccgccatcggtgcagcgggtggttgatgcttttgggacggttggatgacgggattgatcagccgtcggggcgaccgacgcccaggatcaaccccatcatcgtgtcgacaacgcccgtgcgcagcgtcgcttcggctgcaccccctgcaggtgcccggccggccgcgatcagggaagcggcgccatgcaccgccgaccagagggtgaaggcgaccaacccgggatcgcgaccgggcagcggcccctcggcctgcaccgcctctaccgcccccctgagcagggtgagcgaggtcatgcccggatcggccgcgaagggatcgccggcaagatccggcagcggcggaggcgcgaacatcaggcggtagagcgccggatattccgcggcgaaggcgagataggcaagcccgccctcgcgcagccgcgccaccgcattgccggccgtgcgggcggcgacggcgagcttggtctcatagagccgccggaaaccctcgtcatggaccgcccggagcagggcatcgcggttgcggaaatggttgtagagcgcgggcgcgctgcagccgatggcggctgcgacctcggccatggtcagcgccatggggtcgcggtcctccagcaggcggatggtctcgaccaccgcccggccgggaatgtcgatcgcctggtccttgcgcgggcgcgccatgacgtgcctccaattactgaacgatattaaattaatttcattcagtaatgaggtcaagcccggttgacgctctcgctcactgcagccggccgcggacgaagaccaccgccaccgtgagcgtcaccgccgcgatgaccgccagtggccagagattggctgccacctcggaagccggcaatgccttcacgaacgaaccttcgacgatgatcaggaagtgcttcagcgggatggcctctgccatccagcgcagcagcctcggcatgttgtcgaccggcgtggcgaagcccgacatcaggatcatcggcacgaccactgcgaaggtgccgagaatggcctgctgctgtgtggcgcagagcgaggaaatgaccaggcctaccccgacgaccgagaggatgaacagcatcaggcttgcaatcagcagcgggaaggagccggtaaagggaataccgaaaccgaaaatgcccgccaggatcatgatcgtgccgagcaggcttccgatgatcagcgccggcacggtcttggccaggatgatctctcccggtgtggtgggggacaccagcaattggtcgaaagtgccaagctcgcgctcgcgggcaatggacagggcggtcaacagcagcgcaatggtggtggtcaggataccggacagtcccggcaccacgaaccagcggtaaatgagattggggttgaaccagtgccgcagcgccaccgcctcgcccgccgcagcccctccggcttctccaacccggatgcgtgcccccagttgttgggcgatggtggaaagatagccgttggtgatctgggccgcattggcgcggcggccatcgagcagcagctgcgcctcggcggtctctccacgctccacccggcgggagaaatcgggcgggatggcgagcgctgcgatcaccgtgcggtcgtcgatcagccgggccagcgccgcctgatcatggaccgggcgaagccgatgtacgaaacctgccgctccgatccgggccacgagttcggtcgaccagcggccctgatcctgatcgtagacggcgatatcgacattgcgcacctccagcgtcaccgcgaaggagaagaccagcagctgcatcaacggcggcacgatcaataccgtacggctgcgcgggtcacgcaggatgctgagcagttccttgacgatctgggcgcggagacgcgggggaacgaggcgcatgggtcagctgtccaggctcttggcggtcctgagccgcgcgatgatgaagaacaccgagccgatcgccagcatgaccagcagatccggcagcaacacccgccagacatccccggccaggaacaccgtctgcagggcggagacgaaatagcgcgccggtaccagattggtgagcatccggatcggccagggcatggaggcgatctcgaacaggaagcccgacagcatgaaggcaggcaggaagccggtgagcagcgccacctgggccgcaacaaactggttgcgggcgatggccgagatcaacaacccctgccccagagccggcaccagaaaggccgcggtcagggccagcagcgccccccatgagccccgcaacggcacatcgaagacgtgtatggcgagaagtgcacatcccgtcgtcgtcatgagcccgagcgcgaaataggggagcagcttgcccaccagaatctcggtcaccgacgccggggtggaaaggatcgcctccattgtgccacgctcccattcccgcgccacgaccagcgcggtcaacagggtgccgatcatggtcatgatgatcgcgatggctccgggaaccagggcacgccggctctccagctcggcattgaaccagaagcgtgataccagcgagacggggcgggcgctgctgccccctcacgccccgcctgccaggccgccaccagccccagcgtgtagttggcgacgaaactggcggtgttgggctgggagccgtcggtgatcacctgaaccagcggcgtctctcccgtctgaagcctgcgggtgaaatcctgcgggatgaccacatagccgcgcagccgccccgcgacgacgccggcttcgacatcacgccggtcgcgggcgggggtgacggtgaaatagcggctgccggcaaaggccgccgccagcgagcgggcctcggcatcatcggtttccgccaccacacccaccggcacccggcggatgtcgagtgagaccgcgtcggcatagagaaacagcatcaccaccggcagcacgaaggcgatcaggatcgccgacgggtcccgcagaatctgcaggctctccttgacgatcagagccgcaagccgcccggggtcgaagcgccgcaccggtgtcatgcacccgcctcccggtctgcgtcatgcgcctcgatcagcccgataaaggcgtcctccatggtcggctccggcagatcccgggtcacgacccgggccttgagtgcatcgggcgtgtcgagggcgatcagtttcgagcggtacatcaacgccacccgatcgcagtattcggcctcgtccataaaatgggtggtcaccatcaccgtcacccccttgcggaccaggccattgatatgggtccagaattcgcggcgggtgatcggatcgacacccgaggtcggttcgtcgagaaacagcaccggcggccggtgcatcagggcgcaggccagcgccagccgctggcggtagccaagcggcagatctcctggcgcccccgtcagatgacggccgagctgaaaggtctcgatcatctcctcgacccgcgcccgccgcacccgcccctccagcccgtagacaccggccgagaactcaaggttctgacggaccgagagcaggccatagagcgaaaatttctgcgccatatagccaagctgccgcttcgcctcgctggtcgcccggcgcagatccagcccggcgacctcggccgcaccggcgcttggccgcaacaggccgcaaagcatcttgaaagtggtcgacttgcccgcaccgttcggaccgagcaggccgaagatctcgccgcggctgacctcgaagctgacatcctcggtggcggtgaaggtgccgaagcgcctggtgagatggcggcaggataccgtcacctccgtctccaaccgcaccggatccatgcgttcggcgagccgtgaggtgccgccagggccgccgccgagcaggtcgatgaaggcgtcctcgaagcgcggggtcaccgcctcgacccgcgcaccggtttcggctgcgaacggtgccagcagatcgggcgtaccgccctcgcgcagcaccaggcggacggcgtcgccctgaatgaccccgtcgctcacgcccggcaggcccagcgcctcggacaggacctgccggcgatcacgccgcggcccggccagacggaagctgcggtcatggagccgcgcggtcagccctgccggcggaccgtcatattccagccggccttcattcagcagcaaaacggtctcgcagcgctcggcctcgtcgagataggcagtggaccagaccaccgccatcccctccccggtcaacgcctcgaccatccgccagaggtcctggcggctgacgggatccacccccacaccgggctcgtcgagcagcagcaccccgggtgtacccatcagcgcgcaggcaagtcccagcttctgcttcatgccgcccgaaagccgcccggccagtcggctggtgaaagggccgagccgcgtgaaaccgagcaggcgctcgaaaaccggttgcgcccgccgcggcgcgatgccgcgcaacctggcatagagacgcagattctcgatcaccgagaggtcttcatagagcccgaagcgctgcggcatatagccgatcgatggcgccacccggtcgcggtcgtggctgacatcgaccccggccaaacggatggtgccggcatcaggagccataagtccggccatcagccgcatcagcgtcgtcttgccggcaccatccggcccgaccagcccggtcaaccggccacgcaggatccgggcatcgatgcccttcaacgcctcgacaccggggaagctcttgaccacccccgcgacatcgaccgcgacggcgtcatcccctgccggcgcggctgccgccatggcgtcagtcctccctgtccaatgtcaccgttaccggcatgccctgacgcagcccgtcatcggcatcggtgaccacgatccgcagccggtaaaccagatccgtgcgaagcgccgtggtctcgaccgatttgggcgtgaactcggcgcggggagagacgaaaccgatccgcccgtcatagacccgaccgccgctatcggtggtgacccgaaccgccgcgcccggcacggcacgtccaagatccggttccgccacataggcgcggacatagaccggatccttcaacgacagggtatagacaggcgtgcccgcggcagccatgctgcccggttccaggatccgggcgaggatggtgccggcggcaggcgccgcaagccgggcatcctccagcgccgtccgcgcctgatcgcgcgccgccccggccgccgccagtgccgcctcaccggcggcgatgtcttcggcccgcgcaccggcttcgagcagggcaagcgcctgacggcgcgcctccagaaccgccgccgcctcgtcgcgggcggcacgggcggcatctgactcgctttcgctcaccacccgggagccgaccagagagcgcttgcgccgataatcgatctcggcgaagcgcagggtcgcctcggcctgggccagcagggcggcggcttcggcgatctcttgcggccggttgccattgcgcagccggtcgagcgatgcctgcgcctgggcgcgttcggcttcggcgcgggcggccgcatcgcggagcggccggtcgtcgagcaccgccaccacatcgcccgcctgcacggcatcaccttcctcggccgccatttccgcgacccgccccccctggcggaaggcgagcgccacctcgcggatgtcgacattgccgtagagcaccagccgggcatcgctggccgccccggacacaagccggtcccgcagccaaccattggccggcggccagaacaggccgatggcgaccgcagcagccatcccccccagaagcagagcgacacgcaacgcggctttcatgagcgatctccggccgggacaagcatggcggtaaggttgcggcgaagctgcccctggattgcgacgatctcgtccggaccgatcgccggctggtcaatgatccggagcaccgcggcccgtgcgacccggaagaccagcatctggcccatgatggtcgccaccaccagccgtggatcccctgcctgtgccatgggatcgatatgttgtaccaaccggatcaggccacgcgagactggccgcatcaacccgtcgtgaagcagggcgaaagccgccgtcggcgattgctgttcacgtaccacaagctgcgcccagggattgctctcggttcccgccatgaggaggatgaaagcgtcggtcatccggaacagcagggcgagcccgtcctcgcgacccggaggaaggtcgccatccagcgctgcctcgatctccgccaggacggggccgatccgggcacggatctgctcgacgatatccgcaaacaccgccagatacaggccttccttgttccggaagtgatagccgatcagcgcctgattgaccttcgccgtctccgcgatggtacgcgtgcgggtagcatcgaaaccgtcgcgtccgaacacgtcgatcgccgcccggatcaatgcctcccgcgttgcatcgccacgtgtcgcctgtgtcatggctccgggtgcctgtgcagatggggtccaactcagtttgattgatcagatgatttagtcaaatgattaaataattgtcgtcgtgaataagggctgacccgacggatcagcccctctcattcgtctggatgtgctcaggctgcggtgtcgtggcggctgcggcgcgcggcgttcacgccggccaggaattccaggccctcggcggcgatggcatcgcccaccgtgccctcgccctcccccgccagcgcgcccagatcgacccactgggcatagagcggccgggtccggtcggtgatgatgcccgcatgcagcagggtcttgaccagcacccggaagacattggtgctctcggacatctcggcgcgacggacgtcggaggtatagctctccttcatggcatcccgcacccattcccaatcaagccccagcggcgcatagagcgcctgcttctggctgggatggagcatgttgaacatcagaatctgaaagcactgcgccgcccagtcctcgacgccgttgcgcgccttttcgtccatcatcggcagggcatcgcggccccagagcttgccggcgcgatggtggaaggcctcgtcggtcatcaccagctgggtcagccggcgcagcaccgggtcctggctcttggaatgcaggctggcgaaaatgcccatggcgaggccttcgaccagaagctgcatgccgacgatcttgcgcggcacgtcggtcaggtcgaccagttccttcagcagcccgcccagcacgtcggaggccggcatcggcgcaccccagcgggtgtggatatagcggctgaaggcggtgacatggcgggcttcctcgcgcgcctgattggcggcatattccaccacccccggatcggcgagcatatggcagaggctggccgacagcgacagcgccccctgctcgccatgcaacacgctcgacagccaccagcgcgcgctttcattggcgaaccagacccgctgttcggcggtcagccggtcggcgacagcgctgttcagttcgggcacgatcgaggccggcatgaccgtctcggtcgccatgtcgaacggctcgtcgaagcggatataggcggtgtcgagcgggtcccagaaatggcgatgggtctcggcgatgatctcatcgaacagatcggtgcgctcggcatagcgcggcacccggatctgatcgagaaagccggccggtccgaccgctcggaaggcaccgctccggctgacgctggtggtctcgggcatggatgtctcgtcccctgactgatgcggacctgggctgatacggccggatggcatcgggcgcggatcgcgcctcttgttcttgtcttaaggatagaatgattgacgtatacgtcaatcaaggagcgcacgacatgatccggccatcggccggcagccgcgcgccccgtcggaaaccgccgacgatcagaggaacttccgattcgcctcggcctccggcaccttcagccccagcacctcgacccgcggggtgatctgggcgatgaagcgccggcgggcttcttcattggtgtactggcgcaggccccacttcacataaagcggcgagcgcttgctttccgagctgccgaagaggtcgagcgtgatcggccaggccttttccagcatcgcctgggcatccttcagcccctcttccgtctggcagtattcccagacgatccggtagccctgggcgacgtggttgtgctcgtcgatgatgacgctggtgcacatgtcggcgatcggcttgtacgagcttttcgacatctcgtggatctgcgccagcacggcggcttcgccgatgaacgagaacatgccgcggcccagccagttctcgatccggcgcacaccctcggtgcggtagaattcgcgctgatccagatgctgctgcagcatataggcggtgtcgatgccgatatcgtccagcaccgccttgccgcggatgtagtgatccatctcctcggcggcacgctcgcagcacaccttgcgctcgaaggcggtcggcgccatcggatagaagatctggatgtagtcgtcggcaccggtcagctcgccctcggtatgggcgcgcagctgatggatcaccagctcctggtactcgtccggcatctcgcggaaggccttggcatccggcacgagcagccgctccccggcggcagcatgagcggtctgttcggtcatcttgagcgttcctttttggtggtccctcgccgggcgggcgctgccgcgcccttggccgccgcctcagtggcggcttggaccgacccgggggtcggttccgaagggaattggtggtggtggtgattccgtggtccctcgccgggcgggcgctgccgcgcccttggccgccgcctcaatggcggcttgaaccgacctggaggtcggttcaaagaggggggctgagggatgtcggtggctggttgacggcggtgacgacgcccgcagcgcggacgcgggggccgccgcgggcgtcggaaatggtggcggcaagcaggaccgtgccggtgccggcctggccctcgatttcggcacgggcgatcaccccccggggcaggacggggcccagccagcgctgatccagcgagaccaggcgcgagggggcatcgcccagaacggcggcggcagcggcccgcatggcgcgttccatcagcgcctgaaggatgccgccattgatcagcgcacgttcggcgccgcccttgtgaaagggctgaaggcgggtgatggtcgcgatcgccgcatcggggccgtcggcctcgacccggatcgcgttgtgcagcgccaccggctcggccgaaagccgggccgcagccagggcgatcccggccgcggcgtcggtttccggtgcatcggccggcagcacggtcacgccaccacctcaggcgcccggacccggatctcgcccgcctctgccgcctcgcggccggcaacggcggccagaagcgggttgggcagggtttcgccatgggccagatcgaccgagacctgcgcggcatggccgtcgccgatcgggtccatcaccgcctgacggcggccggcatccttggtccagtggaacggaccccagatgaactgcttccagtagctctcggccatctcgacccaggtctcgagcatcaccttgtcggtgaggaagcggtccatgctgaccaccatccacgagatcaccgcctggctgtcgcggcagccgttgcaatggcccgaggtgcagcagaacttcaccgtcttcaggtccgccgcccaggtgttgaagaagggcagcaccgggttgccgttgaccagccggtcggcatggccggcatgatcctgcgacagcgacgggcagacgtcatagccgaagcggccgaaatggctgcggccggtgatcatggtgcggatgtagtagggcgtgctgaccacggtctcgggatatttcgcccgcacccgaagtgcctcttccagcagctcttcctgccgggcaagcgccgtcggatcctcggcgtcataggcgctgtagaagttgaagttgacccggttaccgttgtcgcggatccggaccaccgtgtcttcgatatgctcgatgccggtctcggtcagcgcatagatgaagcccgcgcgcgggtcgtcgcgataattgccgagcgcagtctcgaacaggccgctgaaggtgcggccgctgggcttgatgccgcgcagctgatcgtccatcggcccgccgccgaacagggtcaggccgatcgcgacattctcgaacccctccatcggcagccggcgcagcccgttggacgagatcgtcacatagggcatgtgcttgacatagagccgcagccgatcgggaaagagcgtcggctcgccgccgatcaccagggcggcattcacccgccgttccttggtctccttgatcagaaaggcttccagcgcctcggcatccttggcctcccgcgtggcggtgtcgtggccgtattcgaagaaccagcagcccttgcaacggatgttgcaggcattggtgaggtgatattcgctgacgcggatcttgcgggagaagcgcagcaccgcctgcaggcggtcgcgaagctcgtcctcgccgtcgagcaacgcctccaggcgttgcatgcgctcgcgcgtcacagtgcgattttcgtcggtcttcatccgaggcagccccttcgtcgtcgtcgtttcgcggatcggcgggggtcgcagattgagagccgggcggacgcacgcagcttcccgggcaggcgcgtggtggccacgcgccctcagaagatctggtcgtcatatcagtgcggtgtcgccgcgccggctcaggacccggggatcacagggtccgggatcacgggatccgggatcactcggccgcttcggcgtagcggacccaatcggcctgaccgttcagcatcgcctccacctcctggtggaaccaggcgagagcctgttcgtaacggccgaagacgaaatggtcgttggcaccggaattgagcgccgcctggatggcctcggagcggtcgctgtcctcttcggtcacctcgaagacgacatgcatgctcttcgaccagatgtcctgggcggtggcgctttccagatatttcggcggcaccagcgtgtaggccggcagcttgcaattgtcgatgccgtcgggccagacctggaagatggcgcaatgatcgggcagcaccgccagcatcagattggggaagatggtgtagagcacggtggaatggtcgcgcaggttccaggtctcgcgatcctggtcgcggatctcggggatcgagcgcttgggcagcaccacccgggcatgcggcgacagccggtcgaaggcggcggtgttgtccaggaagaccggccagatggtcttcgtgtgggtgcggcgggtgtgatagttctcaaggaacgtatccagcgccagcttccagttggtcttcttctccagctgggcaggccgccagacgacgtaatcggcggtgccgatatgctcaagctcatgcgccatcggccccagccaggcatcgacatccaccttgggcgcggtcgggtccacctggacgaagacgaagccatagcgctcggcgcaatgcagccggcgcaggcccatctcctcgcgcttcatgttcgggaagccttccgccgcgggcacgccgaccagcttgccgtcggtaccgtaggtccaggcatgataggggcagacgaagctgcgcttgtggctgccgcattcctcccagaccagcttggtcccgcggtggcggcaggcgttcacaaaggcgttgaccgaaccgtcctgggtgcggaccagcaggatcggcaccccggtcacgtccatggtcttgtagtcgcccggcttgggcaactcgctgccatgggcgacgatgatcgggttgcggcggaagatgatctcgacctcgcgcttgtagcgctcgggatcgatatagcggctgaccggattgtgatactcggccgggtccatttccgtggtgcgacgatcgatcatatcgaacacgcgatcgatcagatgcacctgggtagcgtgatccatggcgtcctcatcgaattattgatttttagagcatcgggtcgggtctgcggacgggcacgcatccgggaaggacggctggctgccctggggactcaaactcggttcaaaatatacctgtggttgtgatctatcgcaatgcacgaaatagatgaacaataatctacccatgattcgaaatcttcgacttgggcccgatccggatgatggacgtgtgcaggccgtcgaaaaattccgggggacggctccggccgcgcatgatggcgggcgggtccgtcccccggatgcaggtatgtaatggcgccggccggttcagttgcgcgggtgcagcacggcgcaggtggttgtcgcatgggcgtaaagcgtgccgtcggggccgatcagccgaccttccgccgttcccagcatgcggccggtatggatggcgcggccgatggcgcgcaccgggctgatggtcaccggcagggcccgcaccatgttgaccttcagctctacggtggtagagcccacccccgccggcatcaggctgtggatggcgcaggcgaccgcggcgtccagcagggtcgccatatagccgccatgggcgacgcccatgccgttcagcacatgcgggcccggctcggccacgatttccgcctcgccgcgttcgatccgcgccaggcggaagcccagcgtctcggcgatcggcgacagcgagcggccgccatcgatataggcctgcagctgcgccagcccgtcgaggccggcgatgtcgtgagcttcggcatctccggtcgcactcatgccaccaccacccgccgacggagcatccacatgctgcgcatggtgcagatcacctcgtcattctggttgtaggtcttgtagagcagtttgacgataccgcggtccggcttcgaccggctggggatgacctccgtcacctccagctccagacggatggtatcgccgggacgcatcggcttcagccagcggacctcgtcgaggccgggcgagcccatcgacgcggtcgagacgatctgcgcctccagcaccagcctgaagccgagcgcgagggtatggaagccgctggcgatgatcccgccatagatgctggcggcagccgcttcgcgatcgacatggaagggctggttgtcgaactggctggcgaaggcgatgatctcgtcttcggtgacgctgcgcgcgggcgtgcggaagacctgcccggcggcgaaatcctcgaaatggaggtcggtcacgggcggggtggcggcggtgtctgcggacatgggatcaggctaccttgctgcgggtctcttcctgcggacccttgaaacgaacgtttgatccgcaggagtatgcccgtttccggcggccccgtcagccttcgccattctccgccgcgccgccggtcgcttcgaggaactcgtcctcggtccagacctcgatgcccttctcgcgcgccttggcgagcttggaacccgccgccgcgccggcaaccaggatgccggtggctgacgagaccgagcttgccacggtggcgccatgctgctcggcccggcgcttggcggaatcgcgggtcagcttctcaagcttgccggtgaagaccagggtcttgcccgacaggctgcccgagacctgcgccgggatgtcggcctcgatcacctccacctcggcgatcagggcctccagcacctcgcggttatgcgcctcggccatgaaatcggtcagcgcctcggcaaccaccgggccgatgcctgcaatcgcatccagatccgcccgcgccgggctttccggatcggcggcggcttcgagcccggcgcgccaggcctcgaaagtgcggtagttgcgcgccagcagcttcgccgtgttctggccgacatggcggatgcccagggcgaagatgaagcggtcgagcggcagccgccgccgtgcctcgatcgccgccagcaggttgtcgaccgatttgcggccccagccggcccgcttcgtgaggtcgatctcgccggtttcctggcgccgcggcagggtgtagatgtcgaccgggctgcggatcagcccgtcctcgaagaaggcttcgacctccttgcggcccagcccttcgatatcggtggcatcgcgggagacgaagtgcttcagccgctccaccgcctgggccgggcagatcagcccgccggtgcagcgccgcaccgcctctcccggctcgcgcaccgcatgcgagccgcaggccgggcagaccgccggcgcctcgaagggccgggtgtcgttcggccgttcggccaccaccacctcgaccacctgcgggatgacgtcgccggcgcgctgcaccaccaccagatcgccgatccggatgtccttgcgcgcgatctcgtcctcgttgtgcagggttgcgcgcgagacgaccacaccacccaccgtcaccggctccagatgcgcgaccggggtgagcgcccccgtgcggccgacctggatctcgatgccgagcaggcgggtcttcgcctgttccgccggaaatttatgggcgatcgcccagcgcggcgcccgcgccacctggcccagcagcgcctgccagtccagccggtcgatcttgtagaccacgccgtcgatgtcgtaatcgagcgcgtggcggccgtcaccgatctcgcgatagcgtgccagcagctcgtccgccccccggcacagccggcgcagcggattgacggtgaagccgaagctctccagccggtcgagcgccgcccactgggtcggcgccagcggtgccgaaacctcgccccaggcataggcgaagaatttgagcggccgcttgcgggtgatctcggggtccagctgacgcagcgatccagcggcggcattgcgcggattggcgaacagcgcctcgcccgcctcggcccggcgctcgttcagagtcgcgaaatcggccttgcccatatagacctcgccgcgcacttcgaccagatcgggggcgtcgtccggcagggtgtcgggcacatcgtcgatggtcagcatattgcgggtgacgtcctcgccctcggtgccgtcaccgcgggtcgcagccaccaccagccggcggttctcgtagcgcagactggccgaaagcccgtcgatcttgggctccgccaccaccgcaagctcgtcgtcttccttgaggttcagacccttgcgcgcccgggccaggaactcgaccacatcctcgtcctcaaaggcattggcgagcgagagcatcggacgggcgtggcggaccttggcgaagccctcggccggggccgcgcccaccgtccgggtggggctgtccgccgtctggagttccgggtaaagcgtctccagccggatcagatcggcgcgcagccggtcgtaatcggcatcgctgatctcgggcgcgtcctctttgtaatagcgccggtcatgatagcgaatgcgctggaccagggccctgtggctctgacgcgcctcttcgagcgtgggctgcatcacggtctcgttgcggtcggtcatggccggaaggctccctcaagacgcggtatcgaaggatggggcgcgagatgtacgacgagccggcgccgggggcaagcccggcggcagagccgctcaactgcgcacggccaggctcatcagccggtcggcagcggcccgtgcctcggcggtgagttcggcgccggacagcatgcgggcgacctcttcgcgccgctcggccgcggtcagggcccgcacctcggtgagcgtggtctcaccctcaacccgctttgcgacccgcagatgcaagtcaccacgtgctgcgacctgggggttgtgggtgacgaccaggacctgggcatggccgcccaggcgctgcagccgttcgcccaccgcatcggcgacggcaccgccgatgccgctgtcgacctcgtcgaagaccagggtgccggcgctggcggtacgggccagaaccaccttcagcgccagcatcagccgcgacagctcgccgccggatgccaccctggcgagcgggccggccggcgcacccggattggtgcggaccatgaactggcagcgctcgatgccctccggcccccaggcgtcttccggcagcggatcgaaggcgaccgcgatctcgacccggcccatgcgcagcggcccgagttcgacggcgatcgccttgatcaggtcatcggccgccgccttgcgcgcccggctcagatcttctgccacctcgcgataaacccggcgcgcctcggcggcggcggcggtcagtttcgccgcgaccgtgccgccgccgtcgatcagctccagccgggcgcgcagcttgcgggcaagctcgggcaggtcttcggtcgtcacctgatggcggcgggcggcggcccgcagggcatagagccggtcctccaccacttccaggctgtcctcgcccagatcgaggtcggcaagcagccgctcgaccccggccaccccttcgccgatctcgatcgaggcccgttccagcccggcccgcagctggcggacccgctcgtcggtttcggcatcgggcaggcgctgcagggcgcgatcggcatccagcagccgcacctcgagcgtcggctcgccgttcagcgcatccagcgccgcgttcaacgccgccaccatccggtcggcattctgcaaccgctggcggcggtggaccagatcctcctcctcccccggctgcggcttcagcttgtcgagatcggcgaggctggtgcggagatgatcctcttcgcgccgcacggcctcggcctcggcctcggcgcggtcgcgggcggtgtcggcggcctgcatctcgcggaagcggcgcgccacctcggccttcagcgcctcgtggccgccgaactggtccagcacctcgcgatgggtgcgcgggtccagcaggccgtgctggtcgtgctggccgtggatttcgaccagaacctcgcccagctggcgcagcagacccacgccgaccgcccggtcgttcacccaggcgcggctgcggccatcgggggtgacggtgcggcgcaggatcagcggcagcgccgccggtatctcctgctctgccagcatggtcagcgccggatgatcctccgccacctcgaacacggcggtgaccgaggcctgggcggcaccggcgcgcaccagcccgctgtcgccccgcgcccccagcgcgagccccagcgcatcgagcaggatcgacttgccggcaccggtctcgccggtgaggacggcaaggccggggccgaggtcgagatcgagccggtcgatcagaaccacgtcgcggatcgagagactggcgagcatccggtcttccgtgacgattgcgaagggaacggggggtcgggtgggtggcgaagcggggttgcgggcgatcgcgggatcagaagaccgagttgaaggcgcggctgatccacgaccccttgtcttccaacggctgaagattgcggccggtgagcagggcatagctgtcttcgtaccagtcgctgcccggatagttgtagcccagcaccgcggcagcggtctgggcctcgcgctcgatgccgagcgacagataggcctccaccaggcggtgcagagcctccggcacatgggtggtggtctgatagcgctcgatcaccgtgcggaagcggttgatcgcggcgatgtacatgccgcgggtcagatagtagcggccgatctccatctccttgccggccagatggtcgcgggcaaggtcgatcttcagccgcgcgtcgcgggcataggcgctgtcggggaagcggcgtaccacctcctggaaggcctccagcgacttgcgggtcatctcctggtcgcggccgacatccgagatccgctcataatggcagagcccgaccagataataggcataggcgacattgggattgccgggatgcaggtcgatgaagcgctgcgcggtggcgatcgcatcctcgtactgattggcctgataataggaataggccgccatcagctgcgcctcggtggcccaggtcgaataggggtgctggcgttcgacctcgtcaaagctctgcgccgccttacggtactcgccctgatcgagttcgctcgccgcttgggcgtagatctgctccaccggccgctcgacataggcgggacggtcgtcgtcatcgctcgagcatgcagcaagtgccgccacgcacgccgccagaatgccggcccgcaggatcctgtggacccgggtcacggctgtcgccgtccgcatcgcgatcgcccgttccgttgcgactgccttcgccatccgttccccgtcatgctgctcggtgtcatgtcacgtctctgccggccctggccgggcggccgctactatatcattcctgatccgcacgaacagaggcgtggcgccctctccgcatatccgtgccagcgcccgcggccctgtaaggccaagcgcccgcggccatgcaaggccagcgcccgcggccacccaggatatgtgatgagatcccctcatttcgaggccggaacacttgcattccctttggaaagacccggcaacccgatccgtggacgggaacgatccagccaacgaccgccgtacagcgatggtgcaacatgcacaacgtcaatggcttcgcgcgatgtacaccccgttgccgcaggccgtcccgtacggtgcggcaccctggtttcaagtcttgaaccctgtcccctgcgctccggatacggccgcggcgcggcatttgaagtccgtcggcagctgactcaagaaacgccatgctcacatcccgagaaatggcccaacatccgatatttaccatttcttcaccacgccaaggatttctgagttcattctacaaaatccttaattcgtgtcgatatattcccataaacccgacgacgatccaataattacactattgcgttttgcaaatcgtcacaaaagaagccagatgccataagccctgtcatttgatgggcaaccgagggtgttatcagtttacggcagtttctagcgaaaatgccataaacgattgttttggtgcccgctatgtctcttagcccaccaagaatgattactcgaagttctgtttgacaaagttgtccatgggaccgcaaatatgagcaacaaaaacatgcatagagacgcctgcgctatgggggaactggctagacgtgtcgacaatttcgtcggggagcggatccggctgcggcggacgctgcttggcatgacccaggaacacctggcggcagctctcgatatttcgtaccagcaggtgcagaaatacgaaaccgggctcaatcgtgtgagtgcgggccgcctttacgaaatctcgaccaaacttggcgtaccggtcgccttctttttcgacggtctggaagagattgccgacagcatcgatccggatgcgccgaaagagcatggcggcaagaaccgctcgaccatcgaactcgtccggtatttcaccgacatcaccgaccagaccttgcggacggccatcatccgtctgatcaaggccctggccgaaggcaatggtcagcggggcgaacgctcggacgacctggacatgaccgatcttatggatgacgaccggccgcattgagcgccggttcgccatccgacgatacatcaaaggcccgcatcgtatctcacgatgcgggcctttgatcgtttccggctgacgccgcggcggccggttcaggcggcctcgaccgcccgtgccgtatcgacctcatggcagctggtgtagcgccaggcggtcgggtcggcaaaaagcgcatgcagcagggcattgttcacgccatggcccggggccatgccttcgaaccgcgccagcagaggcgcaccggcaaggtagaggtcgcccacggcgtccagcgccttgtggcgcacgaattcgtcggcgtagcgcaggccttcagggttcagcacccgatcgccttcgaccaccaccgcattgtcgagcgagccgccgcggccgagaccggctgcgcgcatctgctccacctcgtgggcgaagccgaaggtgcgggccgccgccagctccgacgagaagccccgggcggtgaggtcgatcacgatccgctcgcgcccgatcaccgggttggcgaaatcgatggtgacgtccagggtccagcgatcggccggcagcagacgcaccaccgaattgccctgcaccagctccaccggcttcagcacttcgatgaagcgccgggcagccggctgctcgatcatgccggcccgctcgatgacctggatgaaggggcgcgagctgccgtccatcaccggcacttccggaccgtcgatgtcgatgatcagattgtcgatgcccatggcggccagcgccgccatcagatgctccacggtcgataccgtcgccgccggccggtcgccggtggcgggcacgcccagcatgctgcacaaccgggtgttcacgatcgtgtcgtggcgggcaggcaccaccacgccgcccatatcggtgcggcgaaagacgatgccggtatcggcggcggccgggcgcagcaccatttccaccggcgcaccactgtgaaggccgacgccgctgcaccgcatcggcacggccagcgtccgctggcgcaccacgccctgcggcgcggtggtgcggaggaaatcggcgctgtcgcggatgtcgttcaggtacacgggctttgctccgttgcggtcacgtccggatcgggtgcgatccgtcagtgaacaggtagcaagcccggcgtccaggctcaaatcactctttgttaccgattgtaacaacacccctgcatgaaagcgccggcccgtgccgcaagggcacgagccggcgcccgcctgcgcgatgccgagcgaccggacgcgcaagagcgttcgcaaccacccgccccgccggcggaggctgccggggcggggggctaggggtggtgcgttcatgtcggcgggaccggctgcacgcatgattgagcgcgcgcagccccggcgtcccccttggtgtcgtcgtcgatccgcggcgtcgccgcagccgtcagttcgcctgacggcgcaggaaggccgggatttccagcaggtcgttctcctcgtcggccggctgctgacgcgcggtggcaccgccatcgacatggtcgagccgcggcgcacgccgcggctcttccgccgccggacgggcagtcgcctcgctctcgcggcgatgggcgccggtcatacgctgcaggaacgagaacttgcgcggcgccgcctcggtcgccgggcggtcatcgaccaccgcccgcgcgggctgctgctccaccgcacgcggagccggctccagcgccagcggctcttcagccgcctcgatgcgggtgggctgacgctcgggcgcacgcaccggctcgggcgcgatgaagctgccgtcctcgacctcgccgcggggcatctgcggctgggcgctgcggcccccctcgctgcgggcggtggtgaccaccggcgccgggttctcgaccacggtccggcgggcaccgcccgacgccgccatctgcggcgcctgctgcatggcggccgcctgctggctctcgttacgggcctgcgactggccgcgagcggcagcttccgcctcctgctcgcgacgggcgcgctggcgggcgacctcttcggcgtcgatgccggtggcgaccaccgacacgcgcaccgtgccttccaggctgggatcgaaggtcgaaccgaagatgatatgcgcctcgggatcgacttcctcgcggatgcggttggcggcctcgtcgacctcgtacagggtcatgtcgccgccgccggtgatgttgatcagcacgccgcgcgcacccttcatcgacacgtcgtcgagcagcgggttcgagatcgcggcctcggcggcctcgatcgcgcggttgtcgccaccggcctcgccggtgcccatcatcgccttgcccatctcgctcatcacggtccggatgtcggcgaagtccaggttgatcaggccgggcatgaccatcaggtcggtcacgccgcgcacgccggcataaagcacgtcgtcggccatcttgaaggcgtcggcgaaggtcgtgcgctcgttggcgacccggaacaggttctggttcgggatcacgatcagggtgtcgacatacttctgcagctcgtcgatgcccgaatcggccagccgcatgcggcgggtgccctcgaagtggaagggcttggtgaccacgccgacggtcaggatgcccttctcacgcgcgatctgggcgatgaccggcgccgcaccggtgccggtgccgccgcccatgccggcggtgacgaacaccatgtggctgccgtccagatattcggagatttcctccatcgtctcctgggcggcggcgcggccgacctcgggacgcgcacccgcgcccaggccgtgggtgatcatctggccaagctggatgcggcgttcggcctggctctggttcagcgcctgcgcatcggtgttgcagacgatgaactccacgccttccagctgggcgttgatcatgttgttgacggcgttgccgccggcgccgcccacaccgaccacggtgatccgcggggtcagctgcatgctgtcggggatgctgagattaagggacatgacgtgttgcctcctggtcgctcggacttggatccgcccccgccgcgatcgccgacacggggacgggaaacttcgggtcttcagaaattcgacttcagccagcggcccagccggccgaaagtgccgcggccggcatcgggcccggcatcgcgctcgcccacctcgccccaatccgccacggcatgggcgatcaggccggtgacgaccgagaagccggcgccgccggactgttccagctctcccgaggccgcgatcggccggcccagccggacctgacggcccagcacccggcccgccagttcgcgcagcccctgaagctgcgacgccccgccggtcagcaccacgcgcttggcacccacctcggcaaggccgctcttttcaaggcgctcgcggatcagctccagcgtctcctccacccgggggcggacgatgttcaccagcagcgagcgcgggacgttctgcacgccgtcgggttcacccacccgcggcagctcgatcagttcgcgggcatccgacggggtcgcgatcgcagagccatacagcgtcttcatccgctcggcatggaccagcggcgtctccagcacctgggcgatgtcgcgggtgacgtgcagcccgccgacgccgaaaccgtcgacatggatcaggctgccgttgaagaacaccgccatggtggtggtaccgccccccatgtcgacgacggtggtgcccatattgcgctcgtcctccaccaggcaggcgaggccggcggcgaagggcgaggcgaccaccgcctcgatctccagatggcagcgggcgatgcacagctccagattgcgccacgggctcgactgggcggtcacgacatgcatgctcacacccagccgctcgccatacatgccgcgcggatcgcggatgccgccagcatcgtcgatcgaatgatcgaccggcagggcatgcatcacggcccggtcgtcgcccaggaacatgcgccggccttcggcatagatccggcggatatccgcatcggccaccgcatggccggcgatttcgacctccagatcgatcagatggctggacatcacggtcgagggcagcgccaccaccacccgctcgatggtttcacccgccatctgctcggccgcatggaccgccgccaggatcgaggcctcggcctggaccatgtcgacgatcatcccggcgcgcagaccgcgcgccgcctgatggccgatgccgcggacgcgccagcggccatggccgtcaccctcggcgatgaagcacaccactttggtggtgccgatgtcgagtgccgcaatcaggccgccgcgccccttcgccatgttttcccaccttcccgcttgtgcgatgcacactgagtggccccaggggccgttcgcagtcgtcgttatcgttgccgtcgtcgtcgtcttcgccgtcgggcatccggcccggggtcaggcatcgagccccgggccggtcgcggccgcgcccggcggccgcttgacctcgggcttcatccgttcggtcagcgccgccgcatcggtcagacggacggcgaactgaccggcgatcctgagatcgaccgaggtgatcgccttttcgaggatgccgtgatcgcgctccacctcggccagccgcttccaggcctcgacggcaccgcgggccggcaggcgcaccaccacgccgtccttcagatgcacgtcccagcgccggccgccgacccggacccccgccacgaaacggtcggccagatcgggggcggtttcgaccaggtccagcagctgcgccaccagctgcggtgcatcgtcgcccaccaccaccggcagataggcgaagcggccgacatccacgccttcgatcagcgcgcccttgcggtcgaccaggatatggccgtcgccgacctgccagagggcggcggcctgacgctcgcggatgcggacgtaaagcgtgtccggccagcgccgttctatcgaggcgcgctcgacccagggcagctgctccagcctgaggcgcatctggtccaggtccagcgccagcatcggcgtgccctggtcaacagccattgccccaagtacctgtccgggcttcgtttcgtaccgcccttccagatagatttccttcacggccagccccagatggccggcctgaatcaccgcgaaatcatgggcgccgtcggccgccgccccggcggtgccggacgaccacagccaccagccggcgccgccgaccagcgccagcacccccagcctgcgcccccagatggccgcgggcctgagccatttcggccgacgccggcggcggcgcaaagcttccgccagggcggcggcttcctccgccccttcgaagccatgggtggtgacccgcttgacgcggatgtcttcggtgctcaggcgtcgcatgcagcgtgctccaccatccatctgaccaaaggcccgaacgcgatccccacggcggcggcctgctcgggtaccagcgacagcggcgtcatgcccggctgggtgttcacctccagcaggatcagcccctcggtgccgggtttggtatcgtcccagcgcagatccgcgcggctgacaccgcggcagccgagcgcccgatgggccgcctcggcaatctctttcgcccgcacggccaggtcctcgggcacgggtgcgggcaccagatgcacggcgcggccgtcggtgtacttggcctcgtagtcgtagaagttctgcaccggccggatctcggtcagccccagcgccctgccgtccatcacgccgaccgtcagctcgcggccggggatgtaacgctccaccagcaccacgggaccgtgggtccagctgcggttgccgagcggggtctcgctttcgtcgcgcacgatccgcacgccgacgctcgacccctcctgggcgggcttcagcacatagggcaccgccatcggatgctcgcggccgatctcgtcgatatgcatcacccgatcctcggccaccggcaggccggcggcggcgtagagccgcttggcgaccggcttgtccatggcgatggcggatgccagcaggccggaatgggtataaggcagccgcatcaggttcatcacgccctgcacgcagccatcctcgccgaagcggccatgcagggcgttgaacaccacatcggggcggatctcggccagcttcgcaccaaggtcggcaccggcatcgatctcggtcacccgatagccctcgccgcgcagcgcctcggcacaggcgcggccgctggtcagcgaaacctcgcgttccgccgacatgccgcccatcagtaccgccacatgctgcgtggtcatgccttgctcccgctctcgtccgtggttgcccccggcaccgcaccggccggacggccgatgcggcggatttcccaggtcagttcaatgcccgaagcggcccgcacccgcgcgcgcacctcctcgcccaaggcctcgatctcggcggcggtggcgccgccggtgttgatcaggaagttgcagtgccgttccgagacctgggcggcgccgatctgcaatccgcggcagccggcccggtcgatcagctcccaggccttggccccttccgggttgcggaaggtgctgccgccggtacgggaccggaccggctggctttcctcgcgctgcgcccggatctcgtccatccgcgcgcggatcgccgccggatcgcccggccggccgcgcagacgcgcaccggtgaagatccagtccgcaggtgccgccgagtggcgatagccaaggcccagcgccgcggccggcacctcgtggatgcgcccggcccggtcgaccgcggtggccgagaccaggacatcggcgatctcggcaccataggccccggcattcatccgcagcgcgccgccgatggtgcccggaatgcccgacaggaattcaagcccggcgagccccgcccgctgggcgatctcggccacgttcacatccagcgccccggcaccggcgatcacctcggtgccgtcgacctccatgtcgacgaagccccggccaagcctgaccacgacaccggccacaccgccatcgcgcaccagcaggttggagccgacaccgatcaccgtcaccggcacatcggccggcagggcggccaggaaatcggccagatcctgcacgccggccggcttgaacagcgcctcggccgggccgccgacccggaaccaggtcacccggtccagcatcgcgccatggctgatccgcccgcgcaccgccggcaggcggccggccagcggcagggcggcggcaccgccctccccgtcggcggcggcgtgccggatggtctgcgtcagggcggcatcggtcatcacgcgccggcctccccttcggcagcagccagttcgcgcggcagtttttcggcccaggcggtgatgttgccggcgcccaggcacacgaccatgtcgccactcgacaccagcggcttcaccacggcggccagcgtctccggcccgtccagcgccaccacatggcgatggccgcgggcacgcagcccctcgatcagggcgtcacggtcgatgccctcgatcggggtctcgcccgccgcatagacatcggccaccaccacggtgtcggcgtcgttgaagcaggtgcagaattcctcgaacaggctcatcagccggctgtagcggtgcggctggaccaccgccaccaccttgtggtcccgggcgacgccgcgggcggcgcgcagcaccgccgcgatctccaccgggtggtggccgtaatcgtcgatcacccgcacgccgttcgcctcgccggtgacggtgaagcggcgcttcacacccgcaaagccggccagcgccttgcgcaccgcctcgtcgggaatgcccagctcgtcggcgacggcgatcgccgacagcgcgttctggacattgtgcgggccgtgcatggccagatgcagatcggcgacccgccgttccgaccccgcccgccggtcgcggatgaccgcggtgaagcgggcgccgtcgacgtcgtggcgcacgtccaccgcccggatatcggcctgcgggttgaagccgtaggtcacgatccggcggtcctggatctggccgatcagggcctgaacctcggcatggtcgctgcacagcaccgccagaccgtagaacgggatgttctcgacaaaggtccggaaggcttcgcgcaccgcggcgaagctgcggtagtggtccagatgctcggggtcgatattggtgacgatggcgatcgtcgccggcagcttcaggaagctgccgtcgctttcatccgcctccaccaccatccactcgccctcgcccgggcgggcattggtgccataggcgttgatgatgccgccattgatcacggtggggtcgatgtcgcccgcatccagcaccgccgccaccagagaggtggtggtggtcttgccatgggtgccgcccaccgccaccgcggatttgagccgcatcagctctgccagcatctcagcgcggcgcaccaccggcaggaagcgccggcgcgcctcgaccagttccggattgtcctggcggatcgccgaggagacgacgaccaccgcggcattggcgatgttctccgccgcatggccgatggcgacgcgcacgcccttcgcgcgcagccgccggacattcgcgttctctgcgatgtcgctgccctgcacgtcgtagccgaggccctgaaggatctcggcgatgcccgacatgccgatgccgccgatgccgacgaaatgcagcgtgccgatggtgagcggaatgcgcctcatgcggtctcctcgcgcccgccgaacggcagcgcgccgcccgtcggggtctggttggtcgcggcggcccgaaggccaccctcggtatcggccggcagcgcccggccttcggccagggcctcgaccagatcggcaagcctggatgcggcatcggcccggccgacgcccagcgccgcctctgccatgcgcgccagccgggcggggtcttccgccagatcggcgatcacccgggcaagcgcctcgggcgttgccgcaggctgggccatggcgatcgcggcgccggcatcgaccagggcgcgggcattggcggtctggtggtcgtcgatcgcccccggcagcggcaccagcagcgacggccggccggcggccgccagttcggcgacggtggaggcaccggaccgcgccaccaccagatgggccgcggccagccgcgccggcatgtcggcgaagaagggcgccagttcgaccgcggcgaagccctgaccggccaacgccgcctcggccccggccatgtcctcgggccggatctggatcaccagccgggtgcgggccttcagcgccgccggcagcagggcggctgccctgggcagggtggtgcccagaaagcgtgcgccctggctgccgccggtcgaaaacaacacgaattccgcgtccgccgccggggcggcatagggcatgtcggccaccgccgccacctcggcccgcaccggattgccggtcacccgcacccgcgggcgcgccgcatcgggcaccgccttggtgtccgccaccgacagcgccagcagccgcgccttgcggccgagcagacggttggcacggcccagcaccgcattctgttcatgcaaacccaccggcaacccggcgagcagcgccgccagcgtcgccggcagggcggcgtaagatccgaagccgatcacggcggccggcgccagacggcgcatcaggccgcgggccctggccacaccgcgcagcagctcgatagcgcccctgatccgccgccccatccccatgccggacacgccgcccgcgggcagcgcatgcacatccacgccctcgggcatgcggacatgggcgacgccccgggcgtcggtcgcgaaatcgaccgtccagccgcgccggatcagctcggccgcgagtgcccgggccgggaagacatggccgccggtgccgccggtggtgacgacgatgcggccgcgggtctgaacggtgcggagagcggtcatcgcgtgccctccagatagcggcggcgggtcagcgccagcatcatgccgagcccggctgcggttgcgaccagcgacgagccaccataagagatcagcggcagggtcatgccggtggtcggcatcagatggaccgcgacgcccatattgatgaaggcctgcagaccgaagctgccgagcaggcccgagaccgccagcacgacgaacaggtcgcgttcctgcatcatccgcatatagccgcgcaggatgatgccgccgaaggccgcgatcatcagcaggcaggccagcgcaccgaattcctcggcggtgaccgcgaagatgaagtcggtatgggcgtcgggcagcaccgccttgaccaggccctcgcccgggccgcggccgatcagcccgccattctggatcgccgaaagcgaggtcatgatctggtagttgtcgccgctcgacgggtcgaggaagcggtcgatgcggctggccacatggtcgagcatcagatagccgccgaccaggccggccaggccgccgccgaccaccagcgccaccaggatccagggcaggccggcgacgaagacctgtaccgaccaggtgccgagcaccagcatggtcatgccgaaatcgggctgggcgacgatgaaaccgaccacccccaccagcatggcgaccgtgaccagatagccggtcagattgcgccgcacccgcgcatcggccagcgcccaggcggtggtgatgcagaagaagggccgcacgaattccgagggctggatcgcgatcgggccggcgccgatccactggcgcgcgcccttgatctcggtgccgaccaccggcaccagggccagcagcagcagaaagacggcgaagcagatgccaccgaccgatttcacctgatcggggctgagcagcgacaggccgatcatcaccagcaccgccgggatcacgaacagcgcctgacggatgacgaaatgataggtcggcgcgccgatgcggttggcgacggcgggcgaggccgccatggtcaacacgatgccggcgagcaccagcagcaggatcagcagcagggcgacccggtcgacggtccaccaccagcgggcgacgaggctggtatcggtgcgggcgaaggcgatcatgaccgtccctccagccgggcggcgaccgcggcacggaacacgtcgccgcgatgctcgaaactcttgaactggtcgaaagaggcacaggccggcgacagcagcagcgccgtgccctcccccgcctgggcgtctgcggcgatatcggccagcgcctgatccagcgccgcctccagcgtgccgctggccgtccaccgcacctcgtctcccagcgtgcgcgagaagccttcggcggcctcgccgatcagataggcatgggcgacgcggtcgaaccacggccggagcgatgcgataccgcccgccttggcgaccccgcccgcaatccagtagatccgccggaaggcatccagcgccgggcgggtggcctcggcattggtcgccttgctgtcgttgacgatcgcgaccgggccgatatggcccaccgtctccagccgatgtgccaggcccggatagctgcggatgccggcggagatgtcgtcgggggcaaggccgagcgcccgggcggcggcataggcggcggcggcgttctggccgttatggcggccgcgcagcgtgtcgatgccggccaggttcatcaccggccgggcgccgccgttcaggtcgtcgatgagccggaaatcctcgtcgacccagacaccgccggccaccgggcgggtggcggcgatcgggatcacccgcagccggccttcggcggcgagtgcatcgaagacctcgatcgacgggccgtcgtcgcagccgatcaccgcggtggcgccggccggctgctgatcgaacagccggcgcttggccgcgacatagccggcgaaatcgccatggcggtcgatatgatcggggctgaggttcagcagcacgccgacatcggccgcaaaccggctggtcaggtccagctgataggacgacagctccagcacgtaaaggtcagccgcacccagcgccggcagggccagcggcgcgatgccgagattgccgccgaccgccgcacgcgccggtgcgccctcggcggtggtgccggcgatccggccgatgatatggcccagaagcgcggtcgtggtcgacttgccgttggtgccggtgatggcggcatagcgcgcctccccgcaggcggcaaacagcaggtcgacatcgccggtgatcgcgacatgggcggcccgcgcccgacgcacggtctcgtgcgggcgggggaagtgcagcggcaggccgggggcggccaccagcaggtcgaccgccttccagtcgatggcatccggcgccagcacctcggccccggcctcggcaccggccgtacgggctggctggttgtcgtcccaggcgatgacccgggcaccgccggccttcagcgcccggatggtggcgagccccgaccgcgcaagccccgccacgaccacgcaccgccccgcaacgccgggcacgaccggggtcggcagcgtggcatcggggatcagggttgagatcgggttcgggctcatgggacgggctcgcctcttcagcgcagcttgagggtggacaggccgacaagggccaggacgaaggcgatgatccagaagcggatcacgatggtgctctcggcccagcccttcttctcgaagtgatggtgcaacggcgccatgcggaagacgcgcttgccggtcagcttgaacgaggcgacctggaccatcaccgagacggtctccagcacgaacagcccgccgatcacggccagtaccagttcatgcttggtcaccacgctgatcgcccccagcgcaccacccagcgacagcgagccggtatcgcccatgaacaccatggccggcggcgcgttgaaccagaggaagccgaggccggcgcccaccagggcgccgcagagcaccgtcagctcacccgtgccggggacgtagtgaacctgcaggtattcggcatagatcgcattgccgaccagataggcgatgaaggcgaagctcgacgccgcaatcatcaccggcacgatggccaggccgtcgagcccgtcggtgaggttcaccgcattgctcgacccgatcatcacgaacaccgcgaaaggcacgtacagcaggcccagatccagcaacacgttcttcacgaacgggatggcaagacccgaggcctgatcgtcgagggcgatgtactgcacccagaccgcggcggcgacgccgatcagggtctgaagcagcagcttcgccttgccgggcaggcccttggggttgcgccggacgaccttcaggtagtcgtcggcgaagccgatcaggccgaagcccagcgtcaccatcagcacgatccagacataggcgctggtcaggtccgcccagagcagggtggagaggccggcgccggtcaggatcagcacgccgcccatggtgggggtgccgcgcttttcgatcagatgccgctcggggccgtcgctgcggatcggctgaccctcgcgctgcttgcgacgcagccagcggatcagactggggccgagcacgaagctgatcagcagcgccgtgatcaaagcgccgcccgtccggaacgtcaggtaccggaagacgttcaggaagctcagatcgctcgaaagcggatagagcagattgaaaagcatgcgtgctccaaaaccgtgtcggccaccggcagccctgccggtgccgcggcccgttaacccttgtccgtatccgtgtccgcaggccgggcacccgcagccttcagggccgcgatcacccgttccatgcgcatgccgcgcgaccccttgaccagcaccacatcccccggagcgacgccccggacgacggcaggtgccagatcttccgccgtgtcggcatggccgccccgacgatcgggatcgagcccatcgtggagatgcaccatggccggcccggcggtgtagacgaccgccacccccgcgtcaacgaggggagctgtgagttctcgatgaagacgctcggcgtgatcgcccagctccagcatgtcgcccagaaccaccaccagccggccgccttcggcccgggccagatcggccccgagcgcgatcgccgcccgcatcgattccgggttggcgttgtaggtttcgtcgatcaccagcagcccgccgccggcggtgggcatgcggatctgggtgccgcggccttcgggcgcttccagcgccgccagcgccgccgcccccgggcccggctccagccccagcccgtgcagcacgcccagcaccgccagcgcgttctccacccaatgggccccgggcacgccgatcacgaaatccaccggccggccggcgacctcggccgcgaccgccgtgccgccacccgccggcgtcgccttgatcaggcggatcatggcgcgctgggcgccgtggcggctggcggcgaaatcgacgatgcgggtcgcgggatggcccagcagcaccgccgcggccagccggtcgaaatgccggttgtcgcggttcagcaccgccacgccgtcggcttccagcccgttgaagatctcggccttggcgtcggcgatctcttcctcgttgcggaaattgccgagatgcgccggcgccaccttggtgaccagcgccacatgcggccgggcgaggcgcgagagcgcgtcgatctcgcccggatggttcatgcccagctccagcaccgcataatcggcatcggccggcatccgcgccagcgacagcggcacgccccaatgattgttgaagctgcgcaggctttgatggaccaccccataggcgccgagcgcgcgggcgatggcgccacgggtgccggtcttgccgacactgccggtcaccgccaccacccggccgccgaaacgggcccgggctgctgcacccagcgcctgcagggcggccatggtgtcacccacccggatcagtcttgcggccgcatcggcgggcagatcttcgggcacccggtggaccagggccgcggccgcgccattggccagcgccgccgccagatagtcgtggccatcattgctgtcgcccagaagcgccacgaacagatcgccgggccgcacctcccggctgtcgatcgcgacacccgagatggcggcatcgacacccgaaacggaaccaccggttgccgtcgccaccgcttcgatggtccagagaggccgcgtgacgttcatgccgcccctcccccgatcacggtcccaccatgagcatgaagcgccgcgcgcgcgacctcgcgatcgtcgaagggcagcacccggtcgccgatcttctggccggtctcgtggcccttgccggcgatcaccagcacgtcgccggccccaaggccggcaatcgcggcatcgatcgccgccgcccggtcgccgatctcgaccaggccgggaccggccgccagaatctcggcgcggatcgcggccgggtcctcgctgcgcggattgtcgtcggtgacgatggcgtggtcggcctcgcgcagtgcgatcttccccatcgccggccgcttggtgcggtcgcgatcgccgccgcagccgaacaccgtcaccacccggtcgtgggcatgggggcgcaccgccttcagcaccgtctccagcgcatcgggggtatgggcatagtcgaccagaaccggcgcgccggcggcgctggtgccgacctgctccatccggccgggcaccgccttcagataaggcagcgccgccaccaccgcctcgggcgatgcgccgcagccgatggcgagccccatggcggccagcacgttgtgcgcctggaagctgccggtcagccccaagccgaattcgtggcgctggccgcgatattcgatcgccacatgcaggccgccaccggtcatcggctccaccgagaccaggcgcagcacccgggccttgcggccgtaatcgatcaccgccagcggccgcttcagcgccgcgcggacaaaatggtcgtaatggctgctgtcggcattgatcaccgcatagccggccggcgccgcgatctcggcgaacagcttcagcttggcgtcgcgataggcctcgatcgtgccgtgatagtccagatgatcatgagtgaggttggtgaaggcgaccgcgaccggcgcgatcccgtccagccggtgctgatccagcccatggctggaggcttccatcgccagatgccccaccccggcccgcgccgcctgatccagcaggcgatgcagggccaccgggtcgaccgtggtcagccccggcgccgccagatcgcccggcccgtcatagccgagcgtgccgaggctggcggcggccaatcccagccgcacccagatctggcgggtgaacgagaccacagagcttttgccgttggtgcccgtgacagccgcgatcacgcccggccgcttcggatagaagcggctggccatccgcgccagcgcgccacgcacttccggggtttcgaccagtgcaacacccgccggcaccaccgtacctgtgggcgcgagcaccgcgacggcccccgccgccacggcttcgggaatgaagtcacggccgtcacgcaccgtgcccggaacggcggcaaagagcatgcccggccgcacggcgcggctgtcggcggtgatgcccgtgatccgggtatcaccgccgatcgcggtcgcatcgcggtcgatcagctcaataagccgcattcgtcacctcggtatccgactggggaagatcggcggtgacggaggtttcgtcctcgtcgcccaccagcgcatagcgcagctcgttgtcgcggttctgcggcagcaccggcatcgggttggggctgccatcggccgacatcggccgcacgcccaggatcggcgcgatccggcggatcagttcacccgccgtcggggcggcgttccagcccgaggtcgaatagccataggtcttgggcgtgggcttgggctcgtcgagcgtgaccagcaccacatagcgcggatcctgcatcgggaagccgcccaggaacgaggtcagcagcgccttgcgccgatagccgccggcgccggccttttcggccgtgccggtcttgccgccaaccagatagcccggcacctgcgccttcttggcggtgccgtcctggaccacgctgaccatcatcttgcgcacctgggcggtgacctgctcgttgatgatctgctcgcgcaccacacgctcgcccggctgatgtttgatcagcgtcgccggcaccttgtagccgccattcatcagcaccgccatgccgcccacggcctgaagcgggctgaccgccgcaccatggccgaagccgatggtcatcacgttgacctcgcgccacggatggggtgcctgaggcaggcccacttccggcagctcgatccgggccggggtcaggaagccgaagcggcgcatatagtcctgctgccgggtggcgcccaccgccagcgccatcttggcggcgccgatattggacgaatagagcatgatctcgggcacgctcagccagcgccgctcgggatggaagtcgcggatggtgaagcggccgatcttgatcgggtcggtcgcgtcatagccgccgtcgatcttgaccacgcccgcatccagcgcctcggcggcggtgaaggccttgaagatcgagcccatttcatagacgccgagcgtcgcccggttgaacatcgccgggtcttggggattgaccggcgcattcgggtcgaaatcgggcagcgacaccatggccaggatctcgccattgcgcgcatccatcacgatgccggtcgcaccgatcgtctggaattcctgcatcgcatcgcgcagcacgtcacgcagcgcctgctgaacgcggatgtcgagcgaggtgaccagcggcccgcggccggtttcggcgcgttcccgcagcgtgcggtccagcccctgctccagcccgccgcggccggtgttgtcgatattggtgaagccgatgacatgagaggtcagccgcccctggggatagatccggcgctgctcgcgctgaaaatagagcccggggatgccgagggcgttgatctcgtattgctgttcaggcttcagaccgcgctggatccagacgaaacgccggtcgcccgacagctgggcgatcagatcggtctggttcagatgcggcagcaccgtgcgcagcttgaccgccgactccaccggatccagcaccagcttgggatcggcatagagcgaggcggtgatcaggttggaggccagcagcaccccgttgcggtcggtgatgtcggcgcggtccagcaccagctgcggcggcggcgcgccacgggcgacccggggctcgccgccttcatgcagcacgcccaccgcgatcagcttgatcgagagcgcgatgaaggcgagcgcgaagaaggccgcggtgaacagcacgcggttgcgccccgtttccagcgcctgcttcacattgccgtcgagcttgaccgcccgggcgacgccaagccgcacccggcgggcgcgcggcagcggcacgcgcggcttgcgcggggcctcgggcgccgtgttctcagggcggccgcgatcgtcgcggcggggaccgaagcggtcgtcgcgggtcatcgcgcaccccctgtcaacaccacgccgccctgatcgagaacactgtccacggccgcatcgatggaggatcgcggcgccggctgtgcggcagcgacggtcgtattgcgcggcgccggcacatgatcgaccagcggccacgaggccggcggcgtaccgggcttggatttcggccggggctcggtctcggcgcgcggcagcggcagagaggccaggctcaccagctggcgcccctcgagcggcttgatctccagatattcacccgccagccgctccagccgctcgggattgttcagataggcccattcggccttgagcacgtggatcgcctcctgctcgcgcagcaactcggcattgcgcgcgacataggcatcctccaggctcgcgacccggtatttcacccagaacagaccggccgcgatcgcggcggtgcagcccagaagcaggacggtgccgggacggatcatcgggcaggctccctgaacaggccctgggcatcggcgggggcatcccaggcggcggcatcggtgcgccgggcggcacgcagcttggcggagcgggcccgcggattggcggcggtctcggcctcgcccgcaatgatcggccgcgtgccggcaatggcgaagctgggggccgtgcggtcgcggtcggccacgatcgcgacatggcgcgacgggttggcgccgcggccggcccgcgcggtcaggaaccgcttcaccagccggtcttccaggctgtggaaggtgaccgccgccagacggccgccgggcttcagccggcgctcggccgccaccagcccgcgcaggatctcgcccagctcgtcgttcacatggatgcggatcgcctggaagctgcgggtcgccgggtcgatctggtcgcggccgcgcggcggcagggcggaacgcaccgcctcggccagcgccgccgtggtctcgaacggccggccgcgggtgatcgcccgcgccacccggcgcgaggcccgctcctcgccatagatccagatcacgtcggcgatctcgcgctcttcggctgtgttcacgaaatcggcggcgctcatgcccgcccgctccatgcgcatgtcgagcggcccgtcatggcggaaggaaaagccgcgctccgcctgatccagctgcatggacgacacgccgaagtcgaaggcgaccacgtcgaccatcggctcgcctgcggcatcgagcagcgcttccatgtcgccgaaccggccctgcagaaagcggaagcggccgccgctctcggcttccagcgcccggcccgcctcggccgcggtcgggtcgcgatcaatgccgtagacccgggcggcgccggccgccagatagccgcgggaatagccgccggccccgaaggtcgcatcgaccaccaccgcgccctcgacgggggcggaggcggccagcacctcgggcagcagcacggaaacatggggagcggtggtcgcggacatggacatgatcatgcgccctccccgccttcggagggttcgacggaggcggccggggccggccggccgatcgcaggcgcgcgcgtgggatcgagccgcagccggccacgattggccagcgccagctcgcgcgccgccgcctggtgctcggcgaaacgctccggctgccacagctcgaaggtacggcccttgcccacgaagatcaccttgtcttccagccccgcgatctccatcagccgcttcgacagcaccacacgaccttcggtatcgaagggcagctgctggcattcggcgaggatggcggtcgcgaaggcgtcacgctcttccgagaacggatcgaacgtctcgatactttccgacaattgaaggatacgatcgtagccagaggcttcgaccgccgggttgatgaacgacggataggcgacgatacccttgaactcctggttgccaagagcagcacggaactgagggggcaccgacacgcgagccttcttgtcgatcggcttttcgaatgtcgacaggaacagcgccacccggcgaactcctcgagaccactctgctccggagggaccggagccctgctggcgttgccctccatggctggccggtccgatcgccgggggcgatctttcaggccaggccccgaaatctggaccaggactttccgaagcggacccctctgccctggtgcccgtttccgcccgccgctctggaacggcccgtcgctctggaacgaattgggaggagatgggcaaacctgggaatttttggatccttgagccgaaggtatcgaatggcccttagggggtcaagcggacattccgctggaagtccttgaaaattcttcgatgaaacagatgcttggcaaatgctgcgcacatatatcaggaacagggcccagggccttgaaatcacgggacagtgttcgagtgaccgtgaacaaaacgtgaacttatgaatccttgcaggatgcaacagtggcagcatcgccaagcatatgtcgggagagcaccctgtcccagattttcccaaaaatgattcagccatcccatccctgcccaaggccgggaccgatggccgagtgtgcgcgcccgcgtgcgcacatatgggagaggatgggataagggggtcagacggcctgtaagccgggttctgtccacaccccgaaggggcgctggatgaccattcctctgggacgcccgtcgccggacgcctctcgcgaccaacccgaaccgccaggccggaaacaggccctgccgcaaccgagggtttcgatccggcacgcggttcctattcggtcttgctcccggtggggtttaccatgccgcccccgttgccgggggcgcggtgcgctcttaccgcaccctttcacccttacccggcacgcacaggcaacccgaaggtttcatgtccgccggccgggcggtctgctctctgtggcactttccctggggtcgcccccgccgggcgttacccggcaccgtgtttccgtggagcccggactttcctccccgccatccgcccgaaggcgccgacagggcggccatccggccgtctgaacccggcgccaccatgcagcagcgcccccggccggtcaagaacaggctgctcagtctgcgcgcggatcccgggcgaacagctgctccaccgcgaagatcatctgggcggtatcgggcccgcagatgccgccggccagccccaggaagcgcgactggaaggcatggaccaccgatcgggtgaccagatcatagatgccgtcgacctggatccggtagccgatcgccgccagcgcccgctggatgtcggtgacggcctggccggtatcgccttcgccgagcgtcaggcccatctcccccggcaccggccgattggccggcatcaatgccagccccttcgccgccagccggtaccagtcgaaccgctcgcccggatcgtatttgcgcgcgggtgcgatgtcggaatgccccaccacccgggccggcgcgatgtcgtgacgggccagaatgccgcccagcagcgcctccaccgcctgcatctgtggctccgggaagtcgcgatagccccattcatggccgggattgacgatttcaatgccgatcgagacgtcgttcagccgctcgcgcccgcgccaccacgacacgccggcatgccaggcgcggcggtcttccggcaccatgcgggtgatgcggccgtcctcttccaccacccaatgggcgctgacccgcgaggccgggtcggccagccagtcgatggcgacctcggccgtgggcatgccggtatagtgcagcaccaccatgtcgggccgcgccccgtcgggccgcgcatcgtgattgggcgagggccggtcggccagcgggaagcgggcgagttcgggaaaatggtcggcgatttgggcagacatgggacggaacccccgatcgggatcagcgcagccgcctgagcggccccggcagacgacgaagctggaccacggcaaccccggagacgatgaacaccccgcccaccatctccataagccccatggtctcgcccatcagcagcacgccggcaagcacgccgcaaaccggcaccagcagcatgtagatcgtgacctggcccacggaatagcggccgagcaggaaataccaggcgccataggcgatcagcgaggcgccgcccaggatataggccagcgccaccaccgtcgcccagtccagattggccagcgcatccctctgcccgtcttcgaacaggaaggacaggatcagcagcggcccgacacagaacgggccgagccaggcattcagcatctgcggcgacagcgccccatgccggcccagctgcttgatctggacattggcataggcccagagcccgccggccatcagccccaccgccagcccgtcgagctgggtcagcaccttgggatcgcccgccaccagcaccaccccgatcatgcccagcaccagacccgcgatgtggcgcttcgtcagcttctctcccaacaccgcccaggcacagaccgcggcgaagggcacctcgatctggatcgcgaccgacatggtcgaggcatcgacgcccagcgacagcgccacgaacatcagcccgaaatgcccgacgccgagcgtcagaccgatgcccgccagcaaaggcagctggctgcgccgcggccagggcaggaagggcgccagaatcaggaacagcacgccgaagcgcagcgccaccagaaacagcggcggcacggtcgcggtcgcgattttgaccgcgacgaaattgccgccccagatcgccaccaccagcagcgccagcagcacatggccgggcgtcatcggcgtgatggccggtgccggaaccggcgcggaggcggcgcggctcacggccgggccttcgcggcggcgatcgcctcgcgcttctcttccagttccagccagcgctcctcggccgcatccagctcggcccgcgcggcggcggtgcgttcggcagccgcctgggcggcggcgggatcgcgggcatagaggccgggatcggccatcgtctcggccagtttcgcgatctcggcttccagtttctccatggtcttcggcagcaggtccagctctcgcgcttccttgaaggtgagcttctgcggcgcctgggcgcggggcttctcctggggtttcgcctcggccctgcgggccgccgcctccacccgtccggcctcgcgcgccgcctcggcggccttgcggcgctgggtgtcggcatcactccagccgccggcatattcggtgatcacgccatcgccatcgaccgcaatcaccgaggtcgccagccggtcgaggaaggcacggtcatggctgatcagcagcaccgtgccgtcatactggtcgagcacgtcttcaagcagctccagcgtgtcgaggtcgagatcattggtcggctcgtccatgaccagcaggttgcagggcttcaggaacagcttggccagcagcaggcggttgcgctcgccgcccgacagcgccttgaccttctgccgggcctggccctcgtcgaacaggaagtcgcgcagataggccaccacatggcgcggctggccgcgcaccaccacctggtcgccgccgccatcggccagcgtgtcccagagcgtcgcctcgggatcgagtgcggcgcggtgctggtcgaaataggcgatctccagattggtgccgagccgcacctcgccctgatcgggctgaagctcgccgatcagcatcttgaccagcgtggtcttgccggcgccgttgcggccgatgatgcccacccgggcgccgcgcatgatccgggtcgaaaacccgtcggccaccgtgatcggccccgagggcgtatcgaaatgcttgaccaggttctcggcctcgatcaccagccggccgctggtatcggcggtggcgaccgcgatgccggcacgggcgcgggtgcgctcgatatcctggcgttcggtcgcaagcgttgcacgcagttcgtgcacggcgcgggcgcggcgctcgttgcgcttgcgccgggcggtcagcccttcgttcagccacagggtctcgcgggccagcttgtccgccatcttggccagacgctgatcctcttcggcgcgcagatcctcgatctgggtctcgaaggcctgatagcccatgtcgtagcgggtcagccggcgccggtagagccaggcgaccgatccggccacccgctccagaaaggcgcggtcatggctgatcaccaccagcccgccgcggaagcgctgcagctcgccttccagccattcgatggtcggcaggtccatatggttggtgggctcgtccagcatcagcagctcgggctcgatggccagcgcccgcgccagcgccgcccggcgccgggtgccgcccgacagctcgctcatctgccgttcgggatccagcgacagcggcaccgccacctggtcgacccggtaatgccggtcgccctgccccgcctcgaccagcccctcttctatataggcccgcacggtggtgccggcgggggtctgcggatcctgggccatataggcggcgcgcaggcccggccgccgggcgatctcgccgccatctggctcgatcaacccgcccatgatccggagcatggtcgacttgccggcaccgttgcgcccgaccagcgcgatccggtcgccggccgagacggcgatggtcgcctcctcgatcaggtcgccgccaccacccagggtgacgcggatgccggtgagagagatgagcggtgcggacatgggatgacggacttccggacgaaggacggggatcgcggcatggccgctggagatgcgtggcgaggcggccgcaggatgcgacggacgccccgccggttcaaggcccgcctgcgcatgccgcgcctgcaagcctgttcgccggccgaaagtgtctctgaaggaattgcgaggcgatgcaggggcggctcagaaccgccggaggggaccaccatgccggctggaccagacggccctgccctcgggctcgtacagacagagattgccgtcatcctgcatgaccagcgtgcgtcccggtcggttcaggtcgatggcagggtcgtgaagcgccatgatcgggaccgcctgatcgtcatagatcaccagattgccgtcatcctggacagccagtgcgcccggcctgcgggtattggaccagcttcccgaggcccattcgacgtcctgccggataggtttgtcacgccggtacaccaccgcatggcaatcctcctggaagacgaaatcgtaatcgccatcgggagaacacaggctctcacccggcagcagcgcctgaccggcgaccagacgatcggatcgcccgaaacggtaccagccggcacccggatcggccttgaacagatctgcaccatattgctggcgtgtgatcagattccgccccacgatccaggagtagtccgtattggtatggaacatggcccggcggctgaacgaggcatcggtgatgaacaggctgatggtggatccgccggtgacgttcgcccagcccgtcggccccagataggagagcgggttccaaagcccggtgtccaggaccctgaccgactgtttgggggcgatcctgagggcgttttcgtcgaagaaggtcttcaccgtcgcgatctccgccgccgccttgttgcgacgttctcgctcctggatcgtcagattggtgcccttgacccatttataggcctggctgccggcggaggccacctcgcgcagcggggccgagacccgccagatggtctgcagcagcgagaccaacctttgcagccggctcagattgttgacggcagtggcggccgtcgccgcgccggcacctgcgccgagcccggctgtcgccacggtgatcagcacccccatcgcgacgccgctcaggatttcgccgaagacgtaatccttattgggcgacacgatcacgtatatcggctcgtccagcgtgttggtgatgtggatcgcatgtgccatgacacgtccttttccggaaaatacatagagaatcccgcggcctccgccaccgatttccggaagtttacggcacgtcacgtgagagtgcgagatagtatcattctattgaattgttcgcgtggcgttaccgcgccccgcgcagcctcaggatccggtcataggcctcgttgatcgccgcgatcttgcgggtggcgatctggatcatctcttcgggcaggccttcggccaccaggcgatcggggtggtgttcgcgggcgaggcggcgataggcggccttcacctcgtccatcggggcgtcacgcgaaatgcccagaatggcataggggtcggcatcgccgccgggttcgatgccgcgtatggccagcagccggtcgagcacggcgcggtccaggccgaacagccgggcgacctcggtcaggaagcggcgttcggcctcgccaaccgaaccatcggcacgggcgatctccagcagggcgtcaagcagttcttccagcaccgccgggcggtcgtggaacagggccgcgatctggcgggcatagggttcgaagccctcggcatcctttttcgcctcgtcgaagatctgggcgacccggccgacctcgtgctccggcaccgtgaagacccggcggaaggcggcgatctcgtcgcgggtgacccggccgtcggccttggccatcttggcgcccagcacgattaccgcgatcgcgaaggcctgttcgcgatgggcgcggtccagcggcagggccgtggcttcgccggcctcgttatagcgatccaccgcgtgccccatcacggcaccgaccagcgcgccgatcgggccgcccatggcgaaacccgccgccccaccgacgaccttgccccagaaactcatctgcgccggacccccgcgccctctgctgcggccacagcgcggccctgctgccgcgttgcaccatggggtggagcaaacaccaatcggcccgcgcacgcaaggacaccctgagccccgcccgacgatcatccggcaggccgggggcagatcgtttcgccaaacggtttcatccgaaaaagatgagacattttgccgacgatttattgacattttatcgctgagacgcgatcgtttccgggacgggcgctgccggggaggcggcgccgtcggatccgaaccggccgggtgcccccgcgcatccccagagccgaacggatcggggttttacggcaacacatgacgcgccggcggccgccggccgcgtgaggggagacgagcagagatgttcaggacgtggatcggtgcggcgctggtcgccggcatggtcggtttcggtggtgccgcggcacaggcggcggaagcctgggacatgccgatggcctatcccgacggcaacttccacaccaggcttggccgcgaattcgccgagaaggtgaaggccgacaccaatggcgaggtggtgatcaccgtccatggcggcggctcgctgttcaagggcgacgaaatcaagcgcgcggtccagcgcggcaccgcgccgatcggcgagcggctgatctcggccctgtcgaatgaggacccgctctttgcgctcgacgccgtgcccttcctcgccaccgattacgatcaggcctggaagctctatcaggtgtccaagccggcgctgaccgagcgtctggcgaaagagaacctgcacttcctctatgccatcgcctggccgccgcagggcatctacgccaacaaggcgatcgagagcgcggccgacatgaagggcctgaagttccgcacctacaacgccaccatggcccgcctggccgagctgctgcagatggtgccgacccagatcgaggcggcggagctgtcgcaggcgctggccaccggcacggtcgaggcgatgatcacctcgggcgccaccggcgtcgacagccaggtgtgggagcaggtgaagtacttctacgacgtgcaggcctggctgcccaagaacatggtgttcgtgaacaagcgcgcctgggacaagctggacccgaaggtgcaggaggcgatcaccaaggccgccgccgagatcgaggccaagggctggaagatgagcgaagagctggctcagggctacctgaagaccctggccgagcacggcatgaccgtgtccaagccctctgctgcactggcctcggacatggccgccatcggcgagaagatgaccggcgaatgggaagcgggtgccggcgacgccggcaagaagatcatcgccgactaccgcgcgaagtgatcctgccgcctgcgtgaccggatggaggtgcggggtgatcccgcccccgcctccgccccgcccgctgcggaagacggccgcctccccccgccggcccgtccccgacccgacgcccgacgcccgacgacggtggaggccccaatggccctctcacgaccggcccattccgggttggccctctcgcgactgctcgaccggatctacgatgccgcaggcgtgctcgccggcgttgcgatgatcgcgatcgtccttatcatcctggcgcaggtgggtgcccgcctcgccgcctaccccttgcgcggcggtgcgcagttcgcaggctacgccatggccgccgccacttttctggcgctgccccatgccttccggcgccacgcccatatccgcatcaccatcctgctccaggccctgccggatcgcgcccgcctcgtcctcgacgtgatggggctgacggtcgcgaccgtgatcggcttctggttcgcctggtggtcttacgacctcgcctatatctcgtgggaaatcggcgagatttcgcagggcgacgtcgcggtggcgatgtggatcccacagatcgtcatggtcgtgggcggcgcgctcttcgccctttccctgctgcacacactgatcgagacgctcgtcaccggccggcccttcgttcccgaaggcgagaccgggctggacgcggccgcggatcgctgagacgggacctcgaccgatgatggaccagacctatcagctgatcgtgctgctcgtggccctgctcgccttgctcggcggtggcatctgggtggggctctcgctcatgggcgtcgcctatatcgccatggcgctgttcagcccgcggccgatcggcgaggcgatggcgatcaatgtctggacggcctcgtccggctggaccctgaccgccctgccgcttttcgtgtggatgggcgagatcctgttccgcacgaagctgtccgagaacctgttcaagggcctgagcccctggatgcgcccgctgcccggccggctgctgcacgtcaacatcctgggctgcgcgctgttcgcggcgatttccggctcgtcggccgccaccaccgccacggtcggccggatggcgctgcccgagatgaggcgccgcggctatcctgaaaagatgatgatcggcacgctggccggcggcggcacgctgggcctgctgatcccgccctcgatcatcctgatcgtctatggcgtcgcggccgaagtgtcgatcgccaagctgttcatggccggtatcctgcccggcatcgtgctcgccagcctgttcatgggctatatcgtggtctggtcgctgctccaccccgaccagatccccgccgatgacgaggcgccgggctggggccagaagttccgggccctcggcgaactgctgccggtggtggggctgatcgccttcgtgctgggctcgatctataccggcatcgcaaccgccaccgaggccgcggccttcggcgtgatcggctccttcgccgtcgccgcgatcggccgggatctcacctgggccaatttctcggccagcctgatgggtgccgtgcgcacctcgtgcatgatttcgctgatcctggccggctccgccttcctgacgctcgccatgggcttcaccggcatcccgcgggcgctggccgatctgatcgcgagcttcaacctctcgccccttcaactgatcgtggcgctggcgctgttctatatcgtgctcggctgcttcctcgacggcatctcggcggtggtgctgaccatggccgtggtcatgccgatgatcacccaggccggcatcgacctgatctggttcggcgtcttcatcgtgatcgtggtggaaaccgcccagatcaccccgccggtcggcttcaacctcttcgtgctccagggcatgaccggacgcagcatcacctatgtcgcccgggtcgccgcacccatgttcgcggtgatggtggtgatgctgatcctgatcacgctggtgcctgaaatcgtcacccttctgcccggcggcatggtgcggggcgcgggctgacgcccgccccttacccctgccccggcacgaccttccgtcctcaacccacccccgcgcatcggatcgagtttcaacgatgaccgcttccgctcccctcacccgcgacgcctggcagttctggatcgatcgcggcggcaccttcaccgacgtggtggcccgcgcccccgggggcacggtgcacacgatgaaactgctgtccgaaaaccccgagcgctatgacgacgcagcgctcgcagcgatccgcgccttcctggaagtcgaggccggcgccgccatcccggccgagcggatcgccgcggtgaagatgggcaccaccgtcgccaccaatgcgctgctggaacgcaagggcgagcgcacggcgctggtcatcacccgcggcttccgcgacgccctgcgcatcggctatcagaaccgccccgacatcttcgcccgcgagatcacccgccccgaactgctgtacgagcgcgtggtcgaggtgaacgaacgtgtcgccgccgacggccgggtgctggaggcgctggacgaggccgcggccgaagccgccctgcgcgaggtttacgagaccggcatccgcgcggtcgcgatcgtgctgatgcacggctatcgctggcatgatcacgaactggcgctgaaggcgctggcggcgaaggtcggcttcacccagatttcggtcagccacgaggcgagcccgctgatgaagctggtcgggcgcggcgacaccacggtggtcgatgcctatctgaccccgatcctgcgccgctatgtcgacaaggtggcaggcgcgctgggcggcgcgccgctgatgttcatgcgctccaatggcggcctcaccgatgccgatctgttccagggcaaggacagcatcctgtcgggcccggcgggtggcgtggtcggtgcggtgcgcaccgccgccatggccggcttcgacaagctgatcggcttcgacatgggcggcacctcgaccgacgtgatgcatttcgcgggcgagtatgaacgcgccttcgacaccgtggtcgccggggtgcgcatgcgcgcgccgatgatgcgcatccacacggtggcggcgggcggcggctcgatcctgggcttcgacggcgcccgcttccgggtcggccccgacagcgccggcgccaatcccggccccgcctgctatcgccgcggcggcccgctggcggtgaccgactgcaatgtgatggtcggcaaggtccggccggaatacttcccgaagatcttcggccccgagggcgaccagccgctggatgcggacgcggtgcgcgcggctttcgagacgctggccgaccggatcgaagccgcgaccggcgagcgccggccgcccgaggcgatcgccgacggcttcctgaagatcgcggtcgacaacatggccaatgcgatcaagcagatttcggtccagcgcggctatgacgtctcgtcctatgtgctcgcctgcttcggcggcgccggcggccagcatgcctgcctggtggccgatgcgctgggcatgacccgggtcttcgtccatccgctggccggcgtgctttcggcctatggcatgggcctggccgacatccgggcgatgcgcgagcgcgcggtggaacaggaggtatcggaggcgaccatcgccgagctcgatgccctgctggccgatctcgccgccgagaccacggccgagctgaccggccagtcgatgccggaagagcgcatcaccgtcgcctgccggctgcatgtgaaatatcgcggcagcgacagcaccatctcggtcgatcatggcagcgccgacgagatcgtcgcgcggttcgaagacgcccatcgccagcgcttcggcttcgtgatgtcgggcaagccgctggtggtcgaggcggtcgaggtggaggcgatcggcgccaccgaccagcccgaggatccggtgctgcccgccgccccggccggccacgccctcggcaccatggccaccacccgcttctattccgacggcgagtggcacgaggcgccggtctatgaccgcgaggtcatgcagccgggcgaccgggtgcagggccccgcgatcgtgatcgaggcgaccgccaccaccgtggtcgaacacggctgggcggccgagctgaacgagcgcggccatctgatcctgacccgcgtcatcccccggcccaagcgggtcgcgatcggcaccgatgccgatccggtgatgctggagatcttcaacaatctgttcatgtcgatcgccgaacagatgggcgccacgctcgaaaacaccgcccattcggtgaacatcaaggagcggctggacttctcctgcgcgatcttcgaaagcgacggcgcgctggtcgccaatgccccgcatatgccggtgcatctgggctcgatgggcgaaagcgtgcgggcggtgatccgcaagcatggcagcgccatgaagccgggcgacgtcttcgtgctgaacgcgccctataacggcggcacccatctgcccgacatcaccgtcatcaccccggtcttcgccgaggatgcggcggcgggcgacgagccgctgttcttcgtggcctcgcgcggccaccacgccgatatcggcggcaagaccccgggttccatgcccgccgacagccgccatatcgacgaggaaggcgtgctgatcgacggcatccgcctggtcgatcagggccggctgctggaagcagagatgcgcgacctgctgtcgtcgggcagctatccctcgcgcaacccggatcagaacatggccgatctcaaggcccagatcgcggcctgcgagaagggcgtgaccgagatccgccgcatggtccgccagttcggtctggacgtcgtgaaggcctataccatccatgtccgcaagaacgccgaagaggctgtgcggcgcgcgatcgcgaagctcgacggcggcagcttcgcctacgagatggatgacggcgcggtggtgaaggtgaccatcaccatcgaccgcgaggcccgggaggcggtggtcgatttcgagggcacctccgcccagcgcgacaacaacttcaacgcgccctcggccgtctgccgggccgcggtgctctacagtttccgcaccctggtcgacgacaagatcccgatgaatgacggctgcctggagccgatccgcctgcgcatccccgaaggctcgatgctgaacccgctctatccggcggcggtggtggccggcaatgtggaaacctctcaggtcgtgaccgatgcgatctatggggcgctcggcgtgcaggcggccgcccagggcacgatgaacaacctcaccttcggcaatgcccgccaccagtattacgaaaccatctgcggtggttccggcgccggcccggattacgacggcaccgatgcggtccacacccatatgaccaattcgcgcctgaccgatccggaggtgctggaatggcgcttcccggtggtgctcgaagccttcgagatccgcgcgggttcgggcggggccggccggcatcatggcggcaacggcgcccgccgccggttgcgcttcgaggaagagatgaccgtctcgctgctgtcgaaccgccgccgggtgccgcccttcggccttgcgggtggcgccgatggtgcgccgggccgcaactgggtggaacgcaccgatggcagccgcgaagagttcggggcctgtgccacggtcgagatgacgcccggcgacgtgttcgtgatcgaaacgcccggcggcggcggctatggtgagccgccccaggacagatgagaccctccccatgacgacatccggcaccagcaaggcggccccccgggccgccaccctccccgatcccgcccttcccgccgcatcgcggccggggggcgggcgcgggatcgtgaactccgcccatctggtctccgacaagagccccgaactttcggagttcgaattcggcctgatcatcgccgcccacggcttccagcgctggatgacccggtgtatgggggcggccggtctgcgggatctgggccagctcgacgtgctggtgctgcacaccgtcaaccaccgcgcccggctgaagaagctggccgatatctgcttcgtgctgaacatcgaagacagccacaccgtcgcctacagcctgaagaagctgcagaaagcagggctggtctcggccgcccgcaagggcaaggaagcgctttatgccaccacccccgcgggcgagcaggcctgcctgacctatcgcgaggtgcgggagcgctgcctgatcgactcgctccactccctcggcctctccaatcaggagatcggggacctggcccagcgcctgcgcgccctgtcgggcctctacgatcaggcggcccgggcggcgacgtcgctctgaccgggcgggaccaccggtggtatcggctggtggtccttttacaccatatgaatgaaaaatatcacgaaactatctaccaaaaagacaaaacacgtccgttctggcacgatgcacgtcgaggttctgccgtggtggacgatgtgaatgagcgacgccctgctgtcatcgacggatcgagaagaggctctttctcgcgcttatgtctcagcaatcgccgcaggtgccggatacacggtagcggtccaggatttcgatcgggacggcatcgaccttcagatcaaggctggtggcgccatgctcccctccctggatcttcagctcaaggcgacgattgacctgcgcgagggggccgacggcgacttccgctacgcactgcgcaaacgaaattacgacctgctgcgttgcccaaccctcgtcccccgcatcctccttgtcctggccctgccggaagatgaaggagactggctgtccgtgagcgaagaacagcttatacttcgcagatgcgcctattgggtgagcctgaagaatgcgacggccgtcgaaaatacgacagccgtgacggttaccatccctcggacgaaccgtttagacgtcggggaattgaagcgtctgatggagatggccaggaccggagtcgtaggatgaaggtgcagattctcgacaccgaagctttgagagcgatctccccccaggccctcgcggcctatgtccgtagcgaaggctggagtcgtgctgcggcctatggtttgcatggcgacgtctataccgccccgggcaggccggacatcatcctcccccgcagcgagcatctggccgactatgcggggcacatgacccgtctgatccgcatcttctcggagatgacgggctatgacgatctcaccacctatcgcgaactgtcggaagccgaccgggatgtcatacgtatccggtcggtggggctgagcgaggatggaacacttccgctcgatcgcggcgtccggatgatcgaaaaagcgcgggatctggtactggcggccgcctgtgccacgcgctcgccgcaagctctctatcgtgccggcgcaaaccgcgaggccgcagactacatcaagcgggtcaagctggggcagaccgagcatggcagctatgtccttaccttgctcgcaccggttccaccccggctgacacccccgcaaccgctgctcgacgagacctgggacacccccgaagaagaaccggtcgaacgtcaggttacacagcgattgatggcagccctcatagcgtcgcgatccgcagttgagcgtagcacgcgcggcgatgccgaagcctttgagcaggcgatcggcgacggggtgagcgccaatctctgtgaagcgcttgcaggcctcatcgaccagtcggaacggttggacatccgcctgacctgggcacggacccgccccgtgcctgaaatccaccgagatgtcagcttctcaaagacagatgcaggcgtcctgtccgaggctgcccggatcttcaggcttcgtgcaccggtgcctgatgtaactcttcatgccactgtgcatcaactgaaacgagaccaggacgatatcgacggggtggtgacactaaaggcagtcatcgaggacgcgctacggtcagtcaccgtggttctcgatccggcaaactaccggctggcggtgcgggcacatgagaaccagacgcccatcgtcgtcaccggggacctggaacgaagcggtcagcgttggcggcttatcaaccccaaggtgaaggcagtgagcccggaaaagtgaacggagcgcccgattggaaccaaccgcgcatgtccggatccggcactcgggccggatccttgcccgggcggccgaggtcttcggcagccgcgagggggccgaacgctggcttcagacaccgtccccggcacttgaccggcaccggccgatcgatctgctcaggacccggcgcgggcgaacactggtagagaccctgctcgttcggctcgattatggggtttatgtctgaccgggacggcaatcgatccacgggccccctctgtaggtcccgccttaataccagccctgcgcccacccgtcttgacaggcccatctcgttctgagacgtaatgccccggtacgttctcaaaacaagatgatcccgtccgctatggatctcgtctccctcgacatcttccgcaccgttgccgaagagggcagcgtcaccggcgccgcccggcggctggatcgggtgcagtccaacgtcaccacgcggctgcgccagctggaagccgatctgggggtggcgttgttcagccgcgacggccggcgcatgacgctcacccatgaaggccgggtgctgctggactatgcccatcgcctgcaatcgctggtggcagaggcccgcgcggcgctggcgccggggacggaacggctgcggctcggcaccatggaaagcacggcggcgagccggctgcccgggccgctggcgcgcttccgggccgtgcggcccgatgccgtgatcgagctggtaaccggcgccaccgacacgctggtcgacgatgtgctgggccaccggctggattgtgcgctggtcgcccggccgccggtacagctggcgaccgacgatcccctgccccatccggagctgagcgaacgcgcggtcgtgaccgaagagctgctggtggtggggcctggcggtgcggacgacgaccggccgcccgccgcgctcgcggtgctggagcccggctgcacctatcgccggatcgccgaaagcctgctggtccggccggcggccgcccggggccggacgatacgggtgcagcagctgaattcctatcacgcggtcatggcctgcgtggccgccggcaccgcgtcgggcgtgatgccacgttcggtcttcgatctgctgaaggcacccgagggcgtgcggatccagagcctggggccggtagagacggtgctggtcgcgcggcgcgactatcgcagcgccggcttcgaaacgctggccgccctgctggccggggtcgcctgatgaccacatccccccgcatgtcgtcgtcatcccgccgcagccgtggcctgaagcgccgcctgaaggcgcgccggcgcctggccgcgcggatcttcacccccatcctgcccggtgccaccgtccgcgcgcgggcgatcggcgccatgggcgcgctgacggcggttgccgtcaccagcctggtcgcccattggatcctggggccgggctggcatctgccggtgctggtcgccccgaccggcgcctcggcggtgctgctcttcgtgctgccgtccagcccgatggcacagccctggccgatcgtcggcggcacggtgatctcggccctggtcggcatcgccaccgcccgactggtgccagatgcgacactcgccgccgggctcgcggtcgctgctgcgatcggcatgatgtcggtgctgcgctgcctgcacccgccgggcggcgcggtcgccctgtcggccgtgctgggcggccccacgatcaccgaaaccggttttgcctatgccttcgtgccgctggggctgaatgcgctgatcctggtggcgaccggcttcctgttccatcgcctgtcgggccagtactggccgcttcgcgccacgcagccggccagccagccggtcggcgcccggcgtttcacctcggaagacatagccggtgcggtcgaggacatgggcaccgcggtcgacatcagccgcgaggatctggaaaccctgatccgccgcatcgaggcccgcgccgccagtcgcctcgcccgcgaaagccgcacccgccgccaccatcatcgccaccggccgtcctgatataagaggggcggcccgacgccctgcggtgcctgccgggcaggcggcaaatccttgcaatcacagccgatcaccagtggcggccggccgggcgccgcccttgggatcggctgtgcggctgccctcccgccaaatctctccgtagactattgtctactattatgtacaatcataaggcgtgtgtttatctacctaaaagggctttatgcaggggtttaagaaccgtgcgtggagacatggcgcgaacctcgggcatgcaccttgctctgtacaaaatctgtcaacaggctgatcgaggtcgtcatggcgacgctgagcaaatttgatttcaaggaattactgaccggaataagtacccgtgcccggagaccggaggacatcctgtccggcatccgcgccgccgatcttgaaggcgtcatcttcccgcgcttttccgacgacgagtacacgcccttcgcctcgggcgaggccatccatgatggcgatcattcgggctatctggtgctccaccggagcaccgcacagcagatctccgacggggccggcgacagttccgacgcgcccgactacatctactcggtcgccgaaggggacatcgacgatttcgcggcgatcaagggcgccgcgggctttttcaccaaccatccgggcaagaccacattctctccggtgcaatccgtatcggagggaaagtcgacgatcatcgccgcaaatatcgactatcacgaaagcgatgagcccgttgaccttcatttccagacgaagagcggcggttcccgcatcgtcagaaccagaaagcgctggatctcgacggtcgatatcgacggtcgcgaagcccgggtctatgaaggcgacatggtggcgatgtcgggatcacggggcctggtcttcgcgggcgcacgtgtggtcgcaccgtcccggatcgataccctctacaacctgctgaccgacgcctatctggcggccgagaccgaattcgggccggcctctgcctgggaacgcctctccgacacggcgttctttgccgcccatcgcgaagagatccgggagatcgtcgcgtcggatgagttcagaggcttccagtcgctcatcggcttctgtcatgcccagtcgcctttgcgggtctatgtgaacgttcacaaaaccgcctgcgtggtccgggcccggctgctcgcctcgacgctgaccttcgacgggacgggcttgtcgatcgattgcaacgaggcagcactgggggtcggcctgttgcgtgacgaaaggatgtggatcgatccgtcggatatcgacatcctgcgcattctgttcctgggcgacgactgcacgaccaaagagcattacgatcgcatcgtccgccagtacgagcgccggcacggggaccgctactactcgatcttctccgcccggccgggcgcgatctgcgtcgtcagaaccctttgcatgccgttcagcaagttcctgcccgacaatttcgacattgcggattttgcggcgcggcacggtctcgatcctgccaagacgcaaagcgcctttcgccggctgagcggagagcgggaggtctatcacggatgccgcggcatccgcctgttctcgatccgcccggatctggcgcgtctgtggctgcggaccgtgctgggtgcgctggcgcgcgcaaatgccgacggcgcagcggtgaaggtccggttcctcctcgccacgctcacgcttcccgacgaggcatcccgcttcatcgtgacgctcgaagaggtcgcgtcttcgatcttcggaagcgtgaaggccgccccgatcgaaggtgcgacgaccatgctggagaccggtggcgccttcatctgcctggaaagcatcctgaggcaacgcggccacgagctggggatggtcggcggcctgatcgggtcgaacgacttcacgaccgcctgcctcaacatgaatcgcagtgatgcgccgcgccacctgatccccggctatgtcgaacagggcttttttgcatccagcccgttcacccatgtccaggtgtcggtggtgggacgggcgatgcatgaagcgctgcagcgctccacccgccttgccctggagctggaccagcagttcatctgggggcttgcgggcgagttgaccaccgactggcattccgtccagtggctggcgcggttcctcgccccggccggcctgacctatctgtcgaccagccctgaaaccatcatcgcagcactgctcgcctctgccgcaacccggtatcagcggccggaggtcagtcgcgccgcctgaacgcagcgcagcggctcaggtcccggtcaggcgatttcagctgatcgggacctgttcccgcgtccggtgccgacgcggcatctttggccggtcaggtgatcgacttgacgtatttcgtgccatcgatcacgagaagccaggaaaccgcttccgtcgtgtcgttgaccatttcatgggtgcaatcggcatcgaagaaaagactatcgcctgttttcatagtgatcttccggtcgttcaggtggacgctcaattggcccgccagaacgaagatgtattcgtgaatgcctttcttatgcggcgaaaaggggcccgtgcgcccgccgggcccgagttcattatggacgacgtcaaccccacgccctggaaaaatgggcgaaagagcacggcggacgaagccacgtgcgctgtcgtgaaggacaggctgcgcatcggcgggcagatatatgatgctgcttacgtcgtctttgctcagcaggtctgaaattccgacttcgagggcttcggcaagcttgccgagcgtcgtggccgaaaccccgccgtcaccacgctcgatcttcgaaatcatcgccttgctgaccgaggatgccgcggcgagcgccgacatcgacagcccgcgcaactgacggattgccctgaggtttttaccaatatcttcagccgattgctgtgccatcgcctctccgctgcgccgcctgcgcctctgcatgccggaaccgtgtcgcaactctaccaaaattccgccggccctcccgacctgacgaatcggtagacatatgtctactattctaatacggttcaaccattgagggattggaggtgggcgatgttgccagatgaaccgcaaggcctcagccggagatcattgctgaccggcgccggcgcgcttggtgtgggcgtgggtgtggttgcagcagcgccggacgccatccttgtccggcaggccggcgccgaagaaggcagccccccggcaacggcgccgggacaggctgcacagcccgacgccgtcgccggatatcagagtctcggcatcgaagaggccgcgatcgtggaagcgctggtcgcccatatgtggccggccgacgatctgtcgccggatggtgttgccttgggcatcgccgtcttcatcgatcgccagctggcgggcgcctatggccagggtgatcgcctgtatctgagcggcccgttcaggcagggcaaaccggaacacggctaccagcttgcctgcacccccgaagcctacctgaaggccgggttgcgtcatcttgcggagatatccgaccggcgctacgccgcgcccccggatcgcctgacgccggatcaactggaggcgcttctccacgacatatccgagacgccgcccgagcccgccgctttcgatctgaaggcgtggttcaacgagctgttctacccgctcttcgttcggggcgccttcgccgatccgatctatggcggaaaccgcgacaagcaggcctggcggatgatcggctatcctggcctgccggccacctacaccaccgacatggtgacatggcgcggccgccggcatccggcatcggacacgcccatgtcgattcaggatttctcctgagaccgggagcgccgttcaggcgcccgggcccacccccgaaatggtttcagcgaggcagcaatggcgacgcgactgcctgagaaagagatcgtggtgatcggcggcggcctgacggcgggtctggttgcccgcaggctggtgccggccggtcgagaggtgctcgtcctggaacgcggcccggactggtcggggtcggcggtcggagagctgccgcatcagcgggacgagttgcgctggtcgacctatcgcggcatgacccgccgcgaaaacgtcgagacctacaccctgcgccacagcccggacgaggaggcgctgccgatgcggcaggtgctgtccttcctgcccggcttcggcgtgggcggggccgcgcagcactggaacggccagacctggcgcttttccgagtccgattatgtcctgagacagcatctgacggagcgctatggcgcaaaatccattccggatgggatgacgatccaggattgggggctcacctaccgcgatctccagccctattacgaggaattcgaagcgcttttcggcattgccggcaaggcgggcaatctgaagggcgtcaggcaggcgggcggcaatcccttcgaaccctggcgcgccacggaatatccgcttcccccgctggagatgtcggaagcctcgcagatcttcaaggacgcgaccgggcagctgggctatgaggcgtttccgctgccggctgccaatgccagccgcccataccggaacccggacgggatgcagctggggcaatgccagtattgcggccattgcgaacgcttcacctgcgaagcgaacgcgaaggccacgccggcctctctgctcttcccgctcgtccggtcccgcccgaattttgagctgcgcgccggtgcggaggtcattcgtctcaacacgaccgccgacggaatgcgccttgagagcgtgagctatgtcgacgtggcgacgggacaggaattcatccagcccggcgcgctcttcgttctgtgcagctacacgctgagcaatgtccgcctgcttcttctgtcgaagatcggcacgccctatgatccggccacccgcaccggtacggtcgggaagaattattgttatcaggtgacatccggcctgaacatgttcttcccggacagatacataaaccccttcatgggggccggggcgctgggtttcgtcatcgacgacttcaacaacgacaatttcgatcacaccggcctggggttccatggcggcggatacatctccgcaacccagacgaacggccgcccgatcgatacgagacgcctgccgcccggcacgccccgctggggatcggcttggaagaaggcgaatgccgactggtatctgcggtccatgagcatttcgctgcacggctccaactacgccaatgcccggaattacatggatctggacccggattacaaagatcaatggggccggccgcttctgcggatcaccttcgatttcgacgagaacgatgcgcggatgtgccggttcgccaatggcaggatggaagagattgccgccgcagccggtgcgaagatcatcagcaagccgaacgtccgcaagagcccctacgatacccgccagtatcagtcgacgcacaacaccggcggcacgatcatgggtgcagaccccacctcttccgtcgtctcgcctcatcttcagagctgggatgtggagaacctgttcatctcgggggcgagcgtgttcccgcagaattcgggctacaacccgaccggacccgtgggcgcgctcggcctgagactggccggggatcttctgtcatatctgtctgatccgaggcggctcggatgaagatgatcggcagggtcgtcctgggtctggtgtcggttctggccgccactgcccccaccagggccgatccggaacgggggcagacgctcttcgccgcatgcgccgcctgtcatgagacgggccccgccagcagccggcgggccccgagcctgaagggcatcatcgggcgacccgccggaagcctggctgatttccggtacagccgggcaatgagccagagcggaattgtctggaccgacgagacgattcgcaaattcattcagtcgcctcaaggctttatcccgggaaacaggatgccgttctccggaataccatccgaagccgacagggcggatatcgtcgattacctgaagagtatttcaggctagagcaggccccgctcaggtgggatctacaggcatcgttgttggtggcacaggagactccggcatgcgtatcctcatccttggagccggcggaatcggcggctatttcggcggccggctggcctcgtccggggtcgacgttcagttcctggtcaggccgtcgcgcgcggaggttctggcgcggaacgggctggtgatcaaaagccctctgggcgacctccggatgcccgtcaaaacgatgacggcggcgacggagccggtcgatgcggtgctgctggcctgcaaggcctatgacctgaccgaggcgatggaggcggtggcaccggccaccggcccctcgaccctgatcctgccgcttctgaacggtatccgccaacttgatctgctcgatgcccgcttcggccggaaacacgtgctgggcgggctatgccacattggtgcgatggtgaacccggccggcgagatcctgcatctcaacacgctgcagcgcttcgtcttcggcccccggatgccagaccagacggatgcggcggagcggctgttcacggcggtaaggcccggcggcttcgagccggtgctgagccccgccatcacgcaggagatgtgggagaagttcaccttcctcgccacctatgccggcatgacgaccctgatgcgtgcgccgatcggcgccatcatggccgcgcaggacggcgaggcgatcatgcgcgagatgctggacgagtgcctggcgacggcagccgccggcggtcaccgcccgcgcgaagaggccatgacgcagatgatttcgtccctgaccgagcgcggttcggcgggcacggcgtcgatgttccgcgacatggcgcgcaacggccggacagaacacgagcacgtgatcggcgacatgctcgcacgcgccaggacagccggcgtgccggcgccgctgctccgcctcagccttgcgaatatgcaggcctacgaggcgcagcgttccgccacggccgccggatgatgccggcacgtccaaccgcctggctcaacggtctggtcggcgtggtgatcttcagcggctccctgcccgccacgcgcctggcgcttcaggggttcgatccgctgttcctgacctatgcgcgggccacgatcgccgccatggcgggcgccgtcgcacttgtcctgctgaaacagacgcggccgcagagggaggaaatccccggtctggtcctggtcgcggccggcgtggtcatcggctttccgctgctgaccgccctggcgctcgagcacatcaccgcggcgcgcggcctgctctatatcgccctcttgccggtgatgacggcgcttttcgcggtgatccgtgcgggcgagaggccacgtccgcccttctggctgttctcgcttgccgccagcctgctggtcatggccttcgccgcatcgaccgggcgcgtcgccggcacgctgccgggggatctcatgatgctcgcggccatcgtcctctgcgggctcggctatgcggaaggcggccgcctctcgcggcggctcggcggctggcaggtcatcagctgggctcttctgatgacgctgccggtgatgctgcctctggcactctacgcctggccggaagatccgacgacggtcgcccctccggcggttctggcgctgttttatgtcggcctgttcagcatgctgatcgggttcatcttctggtatcgcggcctcgcccagggcggcatcgccagcgtcgggcagctgcaattccttcagccctttctgggcctggctctggccgcggcaatcctcggcgagccgatcggctggtctcttctggtcgtcatgatcctggtgatcagctgcgtcgccgccgcacggcgtttcgcctgaccggcctcatccctgcggatggtcatccatccggttccgggccttcagcttgtggccgacctcgacgatggcatccagggccggcagcagttcggtgccgagcggcgtcaggctgtattccaccgaaggcggtgtcgttggctgaatggtgcgcctgatcacgccacggccttccagttcccgaagccgctgcgacagcactttcgccgaaatcggcggaatatcgaggcgcaattcattgaaacgccgcgggcccgcccgcaggtgccagatcacgttcggtgcccaggccccggcaatgaccgccatgcattcagtcagggcgcaggtcaccggcgggcgcgtacttcggttcttgcggagtttcaggctcatctgcacgaccaggctactgcggggaaaccgggatattcagtaaccaatagaaacctgcttggcaagggtaacctgtccccatagggtcgggtcggtcctgcaatcgggcctgcaacctgggaggtttccatgcggctctactacaaacccggcgcgtgttcgctgtcgtcgcggatcgtgctcaccgagatcggcctggcctttgagaccattcgcgtcgataccgaaaccggggacgactatcgggccatcaatcccaagggctatgtgccggctcttgaactggaaggcggcgtcgttctcaccgaaaacccggcgatccttcagtttcttgccgacgcccatcccgaagcgggcctggtacctgcctctggcggtctggagcgtgcgcgccttcaggaatggctgaactttacctcgtccgagctgcacaaggccttcagcccctatttcaggggccagccgctgaccggggcggaaagagaacaggtcgaagaccgcctggcgcgacgcatcgccgacgtggaacgcggcctcggcgatggccggacctacatactcggcgatcgcttcaccgtggccgatgcctatctgttcgtcgtcctgaactggtcgggtttcatcgggctcgatctcacccgctggccggccgtcgcagcctacagggcacgcattgcagcgcggtcctccgttcgcgaggccatgcgccaggaaggactgatcaccagcgaggcggcagaatgacccgcgccctgaacgacatcggcgacgtcatccaggactatttcgacgcgctccatttctgcgacgtcgacaaacttcagcgcgtctttcacccgaaggcgatctatgcaaccgccgacgagacgccgctgctctaccgcaccatggtcgaatacataccggtggtggccgcccggcagtcgccggcctcgcgcaatgagccgcggcgcgaccatatcgacgccatcgatctcgccggcgaaaacaccgccgtcgtccgggtccgctgctcgatcggtccgcgcgatttcgtcgatttcctgaccctggtgcgcaccgagggtgagtggcggatcatcgccaaagtcttccagatcatcgaacgcccgtcataaggagtggcagacatgccgtatgtaaacataaagatcacgcgcgagggcgcgacgccggcacagaaggctgaactcatccggggcgtgaccaaccttctggcggacgtgctggacaagaaccctgcggtaaccttcgtcgtcatcgacgaggtcgagatggaggattggggcgtcggcggccttcccgtcgccgagtaccgcaagactctcgaaacgtgatcggccctcgaaacgtgatcggtacgtgccgatgagcgcccccagccgccattgaggcggcggccaagggcgcgtcagcgcccgcccggcgaggggctaaaaaacgactctcgaacggcgcccccacgggggcagccaatgggggcgccgtccgatgcttcaggccggaaccgccaccgtcccggtctgaagcgtcttgagcggccgcgccgggtcggcgagcgcggccggatcgaggatcggggccagggcgtccgcctgggcctggatcaggccgcggccctgggcgaaatcgagtggtgcattgacgcagtcgatcgccaccacccggccgtcgcggagataaacggccgagaaactgccgctctcgggccggccgcgcaggatttcggtgtcatggcccggcgcgatgccgatggtctgcagcttgatgtcgtattgcgacgaccagaagcgcggcacggcatcgtagggctggtcgccgccgagcatggcgccggccaccacgcgcgcctgatcgaccgcgttctgcacgcattcgagccgcacccggcggccgccggcgaagcggttgacatgggccgcgcagtcacccagtgcccagacatcgggcaggccggtccggcagaggccgtcgaccgccacgccgcccgctgcttcggccccggtggtggcgccggcggcggcgagcgccgaaacctcgggcaccaggccgataccgacgatcaccagatccgccggcagacagtcaccatccgacaggaccacgccagcgacccggccggcggcatcaccggtcagcgcctcgacgcccacacctgtgcggatctcgacaccggcatcccggtggcgcgcctcgatggcggcggcgatgttgcggcccgacacccgggccagaacgcggtcggcggcttcgaccaccgtcacccgatggccctggccgaccagcgccgcggcggcttccaggccgacatagccggcgccgaccaccaccactcgcgggcggcccgagagatcggcacgcagccggtcggcatcggccaggctgcggatggtgtgaatgccggacaggtccgatcccgggcaggtcagccgacgggcggtaccgccggtcgcccaggcgagccggccatagccgatgcggcggccatcggccgtgaacagccggtgtgcggccgggtccagatcggtgatccgggtgccgggcacgcgggtgatgttgcgctccgcccagaagccgtcgggccgcagccggatatcggcggcaagggcggcaccggtcagataatccttggtcagcgacggccggtcgtaaggggcttcgtgctcagcgctgatcagaccgatcgtgccgtcgaaaccgccctggcggaggctgatggcgagctgggccccggcatggccggcgcctgcgatggcgatgtcgaatgtccaggtcatcgtcctgctcccggggggaaacggaaaggccggccgggggctgcgtgcgggggtacgcagcaccccggccggcggcagcgggatcgcgaaccggtgcgcctcaggcgtcgagcggttcgaaatcctcgcgacccgccccgcaatcggggcaggaccagtcgtcatccaggtcttcgaggcgggtgccgggcggaatgccatgggccggcgacccggtcgcctcgtcgtagacataggtgcagagcaggcacttccaggccttgccggcgggggcgccggcctcggcctcgatcttggcggtcatgggcacggagaggattcccgatttgtgtcggatgtggtgagcaaaggcccggcgtcagatcgcaatacccatagccgtgaagctgttgcggccggcatcggtcgagagaatgcccacctcgtgcgacaggccgacgatgccggtatagtccagccgctcgcgggcggcggcattcagcgggcggcagtccgcgacgatggtcgcggcacccggcacacgcagctgctccagcaccgacgaccagatgtcgagttcgagatcggcgaaccattcgatcggcttgggcagcacgctggcgaagaaggcctgctcgcgcgggctcagcgccgggtagaaggtcttggtcatcagggtgaagatcttcgaatgcgccagctcgtcatggcgatgggcggccacggtcgccatgttcatcggctggatctcggtgcaatccgagagctgatgcagatagtcgctgacgaagatctcggagacgaccgaggttgccagatgcaccagaatcttctgccagtcttccgactggacagccttttcgcggttcatcatggtgaccaggttgaagccggggatcttcaggtcttccaggccccgctgtgcgcgggtcagccggttggcattggcgaccagcagcaggtgataggcttcgtcgaccagggtttcgcagacgatctggcggctggtctcgtcggtcaggccggggatgcggccgtccagcgcgtcatagcaggagggcgagacgatcgcgctttcgatggcgacggtcttctcattgtagatgatccagccggccgacaggatcttcgacttcagctcgggcgccagccgctggtagagcgggtgggcgtggaagggcagcagctcttcgaggaagtccggccgggccggatcgaaggcgagatcgaccgcatcgcggcgcaccttggcgcgcttgatccagccgtcgccgatgcgctgcagcagcgccttgacttccgactgctcgtgctgatgcgcggcgtcagtgccgccgggggcgatggcgggggcgctcatcgtcgtcatgacagggctctccgaaaacatgtgcgaagggacagggtcactggtccgcgcacccgtggctcaaagcgggtggcggcatccatctctctcggtcgatcttcgaacgacggcgtctcgtccggcggggtcgcgcggcgggccgttctccttggtgctggcgcgggtccatggcggcccgcatctcattttttggcctatgtcattattagtaacggcctgtgccataaactagcgatctgactttattctgtccagcccaaacacaaccattggtaaaagaatcctgagaaattttcatgtctgattgggatcgttttcttttcaactcagctgcataggtcaggtgatctggcttagtgcaacacgccatggttgcggtttcacataactgtcatgaaaaaagccgcccggttgtcgccgggcggctccagtggcgtcgcgggtgaggctcgatcccccgcaacgtgggagtggacgacagacgggtgctgaaaaaagcggtatcaggccgccggcagcgggaaacgggcgcaaagggcatcgacttcggcgcggaccgcggctgcggtcgcggcatccagcccgccattgtcgcgcagcgcccccagaacctgcaggatcagccggcccacggtttcgaactcggccggcccgaagccgcgggtggtgcaggccgggctgcccagacgaatgcccgaggtcaccatgggcgtggcggtgtcgaagggcacggcgttcttgttggcggtcagccccacctcttccatcgcctcgaccgcggctttgccggtcagcgcgaagggtctgagatcgaccagcaccagatggcaatcggtgccgccggtcaccagccgcaggccgcctgcatccagcgtgcgggcaagcgctgcggcattgccgacgacgtcgtggatataggcgcgatagtcgggctgcagggcctcgtggaaggcgacggccttggcagcgatgacatgcatcagcggcccgccctggacgccggggaacaccgccttgtcgatgcgccgcgcgatatccggatcgttggtcaggatgatgccgccgcgcgggccgcgcagggtcttgtgggtggtggaggtcaccacatgggcatgcggcaccggatcgggatagaggccgcaggcgatcagcccggcataatgggcgatatcggccatcagccaggcgccgacctcgtcggcgatcgcgcgggcgcgggcgaaatcgatcgtccggggataggccgagccgcccacgaagatcagccgcggccgggtccgccgggcttctgccgccatctggtcccagtcgatggtctcgtcatcggcgcgcaccttgtaggtgaccgccttgaaccagcgcccggacaggctgaccggcgagccatgggtcagatgcccgccgcaggcgagatccagccccatcaccgtatcgcccggctccagcagggcaaacagcaccgccagattggcattggcaccggaatgcggctggacattggcataggcggcgccgaacagccggcgaacccggtcgatcgccagcgtctcggcctgatcgaccggatcgcagccgccgtaatagcgccggccgggatagccctcggcatatttgttggtcagcaccgacccctgggcctcgcgaaccgcgcggctgaccaggttttccgaggcgatcagctcgatctggctctgctgacggcgttcctcggcgcggatggcgcgggcgagatcgggatcgatggcggcaagcggcgcatcgcgatcgggaacggaaacaggcgcagtcttcagcatggtggcgatttccgaaggcagcggtggggggaaagaagcgacgacgacagcagaacgcgacccgcaccagccacccggagtggctggtgcaagccgccattgaggcggcggccaagggggcggcagcccccgcccggcgagggactaacaaacctccgccattgaggcggcggccaaggccacggtagtggccgcccggcgagagccaaacagactcccgctcccgcacgccccccgtgcgggagcaagccgccattgaggcggcggccaaggccacggtagtggccgcccggcgagagccgggcagactcccgctcccgcacgccccccgtgcgggagcaagccgccattgaggcggcggccaaggccacggtagtggccgcccggcgagggactgacagactcgcccgcccggcgagggactaacagcctacgcgtcgagattgcgcagccaggtctcgaggcaggcttcggcgcgcggcttcaggatcgggccccagtgctcgttgtcggcgcgcagccgcggcacgtcgacgccggcggcgccaagctcgatggtgtggccgatcagccagcgctcgaagccctcgccgcccgcttccgggtggaactgggcaccgaaggcattggcaccataagagaaggcctgcaccgggcagatttccgtggaggcgagcgcctccgccccctcgggcaggtcgaagcgatccccgtgccagtgcagcaccggcccgccctcaaacacgttcaggcaggaccggcggccggcgtcagtcagcgtcagctccgaaaagccgatttccttggcagggcccggatagactttcgcccccagcacccgcgccatcagctgcgcgccaaggcagacgccgaagatcggcttgccactggccaggcgccgctcgatcagctgcagctcttcggtgaggaagggatatttctcctcctcataggcaccgatcggcccgccgagcaccacgatcagcccggtggtcaggggatccagggtccagagctcgtccacaccggcatcgtagtagtggaccttgtagccggcgcgttccaggaccggcccgaagcagcccagatcctcgaaggcgaggtggcgaatggcgacggcggtcttcagcatcgttgcctccgattaatgacacatgccaatatctcatttggcatgtgccgatatatctagcctcttcctcgccgcactgcaaccacgacgttcgcccgaaatgcacgacccgggcagcctggttccgcctgccgcgacacgccacacctgccggccctctccccgcgtccctgtcgcggcagtcgggaccggctcgccgattgcccccgaaagcggatgacgccataaatgtccgagacactcggtccgatccggacccatgccccactcaccggagtccctcacccgatgcatttcgtcaccggcagatcggcggcagagatcgccgccagcgtcgagcgggcgatccgcagcggccaggtctcccccggcgagcagctgccctcggtgcgcgacgtggccgaacggctgggcgtcaatcgcaacaccgtgactgccgcgtacgcccgtctgcgtgaagccggtctcgtcaccggaaacggccgccagggctcccgcgtggccgcgccgccctcggtcgagatttaccgcagcgagataccggccgatgtccgcgacctcgcctcgggcaatgtcgacgcgtcgctgctgcccgatctcgcccccttcctcgcccggctcgacctgccgcccggtggctacgagatggtggaggacgatcccgaactggtcgcccatgcccagcgggtgttccgcgccgatggtctgcaggccggccgcatcgccatcgtctcgggcgccatggacgggctggaacgggcattgcgcgcccatctgcggccgggagatccgatcgcgatcgaggatccgggctatgtctcggccctgctgctggtgcgttccctgggcctcaggcccgtgccgatggccctggacgaagacggcgtgctgcccgaagcgctggatgccgccctcgccgccggggtgcgcgcggtggtaaccaccccccgcgcccagaacccgaccggcgcctgtctcggcgccgaacgggccgccaggctgcgcgccctgctcgaccgccatcccgaggtgctggtgatcgaggatgatcacgcgagcgccgtctcgggcgtgccggcccagaccctcgcccccgcccgcatggccgcccgcccctggacggtgatccgctcggtgtcgaaattcctgggcccggatctgcgccttgccatcgtcgccggcgacccgatgaccatcgcccgcatgcaggatcagcaggcgctgggcccgcgctgggtgagccatatcatccagcgcctggtgctcaggctgtggacagcccccggtaccgaccaggtgatcgagcgggccgcccgttcctatggggcccggcgcgaggccctggccgcaaggctggccgatcacggcgtcatcgccctcggccgatcgggcctgcatgtctgggtgcccgtccagcgcgaagccgaggtcgtccagggcatgctcgcccgcggctggtccatccaggccggggaaatcttccgcctgcgcagcggccccggcgtgcgtgtcggcatcgccggcctccatccgggcgaagaggacaccgtcgcccgggccctggccgacagcatgcggccggggcggttgctgtatacgtagagggagggagaggttgttttagcccctcgccgggcggccactcccgtggccttggccgccgccgagtctgttagcccctcgccgggcgggcgctgccgcgcccttggccgccgccgcaatggcggcttgcaccagccatctaagatggctggtgcagctctatgggaacggcctgagtactcggtccggtacccgacgtcgctcaggtggcgcgggggtcctgggcgacggagtgttcggtgccggccatggaggtgaccgcgaaggtggtggcctcgggggccggggccgggtggtgccagatgccggcggggatgaccacgaagccgcccgcctcgatcttcacggtttccggaccgctgtcgtgcagcagggtcagctggatggcgccgtccagcacctggacctgctcgtcatgggggtggcgctcccacggcacctggccggcatagcgcagcagataggccatgcagccattggccgcggccagcggccgcatcgccgccatggcgtcttccggcctggtatcggggccgatggtcaacaggggcagatcgccggcgatcttaccgatggcatgaacgtccatgacacacatctcctctcctggcgtggcaggggcgccggtgcttcgccggcaggaggagattccaccatggattgaaccgttgagtcgatatgcgtcgtaaaaattcattatttgcgcgaggccccgtctctgccgggccggctctcacaggaacgtgacccgccgcgagcggcttccggcttgccccgccggccgatctgccgacatctgtggggaagccccatccgcctcagagacccgccagatgtcctcagcccgcacgcctgccctgccctggaacgacccccgcggccgcttctcgccgatgaaggcgctggtcttcggcctgctgctgctgccgggcgtgtggatgatctggaccctggtcgcagccgcaccggacatgccgcagcagccaggccccggcatcgggcttcaggggctgccggatcggggactgctggggccgggcgggccggccggcggcatcgacgaagccgggctcagcgtgccccaggtcaaggagaccctgctgctggcggggctctgggccgtgcggctgctgaccctgtcgctgctggtcacaccgctcaaactctcactcggccggccgaagatcggccagctccggcggatgatcggggtcgcggccgggctctacacgctcacccatttcgggctctatctcgtctggatgaagctggatgtcgcgcggatcgcgtcggagatctggctcagaacctatctcaccatcggcttcgtggccgtgctgatcctggcggctctgctcgccacctctaccgacggcatggcgaaacggctgggggggcgtgcctggaagcggctgcacaaggcggtctatgccgccgccctgctcggcgccctgcactttttcatgcagacccggctggagccgggggaggcgaccattctggccggcattctgggctgggccgcgctctggcggctggccgatgcccggcgccccggctgggtgcggggggggccgggccttgtcggcctcgccctggccgcggggcttctgaccgtcgggatcgaagcggcctggttcgccttcggcaccagcctggatcccgggcgtgtggtggcggccaatctgatgcccgatgtcttcccgcgccccgccgcggtggtggcgatggccgggctcgggatcgtcgggctgcacctcgccgtcaggccccgcccccgcgctcagcctgcccggccgcgccggaattcggtcgcatagatcaggagcatggcaaggcccagcccggcaccggccacgaccacgcccacccagccgccggcatgatagatcaccgtgccgagggcggcgcccgaggcaccggcaaagaacatgatcgtcatatagatggcattgacccggccgcggatctcgggcgcggttgaaaagatgatccgctggccggtgatctgattggcctggatggccgcgtccagcaccaccgccagcaccgccatggcgatgatcgagccggccgaaaccgccacgcccgagacgaggaacgagaccaccaccagcaccatcgccaccccggtctgcacccgactgtagccgcgatcggccagccggcccgcgaccggggcgaccagcgcgccgccggcacccgccagcgcgaacaggccgatctggtggatgctgaggccgaaacgctctgccagcatgatcggcgccgtggtccagaacaggttgaaggccgcgaacatcaacgcctgataagcggcccgccggcgcaccgccggcaggcggcgcagcaggccgggcatggatcccaggatgcgaagataggcgacaagccccgatccgctgcggctccgccccggctgccaggccggcatcatccgccagagggcggcgcccaccacaagcatcagcgcggccgaggcccagaacaccgcccgccagccgaagctgccggcaatgaacagggcagccggccgcgccagcatgatcccggtcaacagcccggccatcaccgtgccgaccacctggccgcggcgttcatcgggcgcgagtctcgcgatgaacggcaccagaacctgggcgccggtggcacagaggcccaccatgaagcagaaggcgaagagcggcatcgcctcggtcgacatcgcgatgccgaccaggcccagcgtggtcagcaccagcgtcgccagcaccagccggcggttttcgaccagatccgcggccgagaccagcaggaacagacccacgccatagccgatctgggtgatgccggtcagcgagccggcaagatcgggatcgagccccagatccgcgccgatcgccgccaccatcggctgggcgtaatagagattggcgaccagcgcaccggtcgccacggcaaaaagcgccacgagggccccggagggccctcgcgacacggatggttcagaggtggccgcagcctcgctcaccgatcgtctccccgccgccgggaggccgcgcgtccggtcccctggcgttccagcatccagcccggatattcgggcggaagcgcactcaccgcatccagccgcgccagatcctcggtcgacagctcgacctcggtcgcggccaggttgtcgtccagctgctccaccgtattggcaccgatgatcaccgacatcaccgaccgctgatgcagcagccaggcgagcgcgatccgcgccaccgacacgccccgcgccgccgcgatctcgcgcatcacgtcgatgcagtcgaaggcacggtcgcggttcaccggcgggaagtcgaacgtcgcccggcgcgacccctcggggccgttgccgtcacggtcgtacttgcccgacaagaggccgcccgccagcgggctccacaccatcagacccagcttttcggcctcgatcagcggcaccagctcgcgttcgagatcgcggccggcgatggtgtaataggcctggagcgtggcaaaacggctgtagccgccccggtcggcgatgcccagcgccttcatgatccgccaggcggaccagttggacacgccgacatagcgcacatggccctggcggacaaggtcgtcgagcgcccgcaccgtctcttcgatcggcgtcaccggatcgacgccgtggatctggtagaggtcgatatagtcggtacccagccggcgcaggctggccttgaccgcatccatgatatgcccgcgcgaggcgccgcggtcattgggcccgtcgcccacctgccccagcaccttggtcgccagcaccatgtcggtgcgcggccggccggaattgcgcatggcatggccggtgatctcttccgacagaccgccggaatagacatcggcggtgtcaatgaaattgacgccccgatccagcgcccgggcgaggatcgcatctgcgcccgcctgatcgagcctgccgatctgggtccagaagccgccgcggccgccgaaggtcatggtaccgaggcagagttccgacacgagcaggcccgtgccgccaagggtgttgtagcgcatcgctttccccattcgatcgctgtcgttgtcgacaaggcccgatatggcacgggggactgcatcggataaccgcccggatcggtcacgccgtgtatagtatgactgaacaatggcggtgcgatccatcacccccgctcctgcgatccggaccaaacatccatggcgaacggcgaccccttcgacgggctgcatgaatttctggccatcgcccggcgcggcagcatccgcggggcagctgccgagcttggcgtcacgccgggggcggtcagccaggcgcttcaggggctggaacggcggctgggcctgccgctcttccatcgcaccacccggcggatttcgctcaccgaggcgggggaaaccctgctcgggcggctgggccccgcggccgacgccatcaccggcaccatcgacggcctgcgccggatgacggccgaaccctcgggcacgcttcgcctgctcgcccaccggatggcggtggaaacggtgatccacccgctgatcccggccttccgcgccgcctgccccggggtcacggtggacatcaccatcgatgacgggctggaagaccagatcgccgggcgctacgacgcccatatcgcgatcggcgaattcatcgaccgcgacatgatcgcggtcagggtctcgcgccccttccgctggctggtggcggcttctcccgactatctggcccggcgtggccggcccgaggtgccggaagacattgcccgccacgactgcatccgcttccgcctggcccgcagccggcggatctatcgctgggaattcgaacgccccggccccgacggcaccgcccaggcactgtcggtcgacccgccgggggacatcgtcaccaacgacacaaagctggtccgcaccttcgccctgcaggggctggggctggtctacgggtcggagctgatgctggcggaggatcttgccgccggacggctggaaacggtgctggatgccttcatgcccgcccgcgacgccctgttcctgtgctatccccgggccagccgcagcgaccccaagcttcgcgccttcgtggaggcctgccagcggcagctgcgccgcagcggcggctgacccgtcaggcggggcggcgtacccccccggccccgccgtccggaaccggtcgagcccggccatgcagaacccgaccatgaaatcgaccagcaccggcttgtcgcgcgcatcatccgccaccttggcgaagggccagatgatcgcctcgtccagcgcgccggtgatgcaggcggcggcaagctcggtgtcgaaggggatgaattcacccgcggcgatgccgtcctgcaggatctcggaaaacagcagatggaagcggtggcggcagtccaggcgcaccgcctcgatctcgggcgagaccggctcggccagcagggcatgggccagacgcggccggcgcagcgcgcgttcaacatgcacctgcacggcggccgccagccgctcgccatgcgggcccggccggtccgccgcctcgaccgaggcggccagttcgcgcaaggctgccgtccggaagacctcggcataaagcgcggtcatggtcgggaaatagcggtagatcgtgccttccgatatcccggccttctcggccaccagccggctgcgcacaccccggaaaccgacctcggcgatcagctctcgggtcgccttcaggatcatcatccgccgctcggcaaggcggcggcgggtctcgggcgtctgtcgataggccaaggctgggggctccggtccggacatatcctcctgcgagcatgcaccgccatgcacgcacttgccagtggataaacaatgagtccatactcatttcttaaaggggccatcatcgggtgaatgacgtccgcacccgtatcgaccatcccggtcgcccccgccggacggagagcccagatgaccgtcgatccgcgtcccgatacccaacctgtagacgatcttgatatatcacaggcaatccgggatgccggagcaaaaacgcatgaggtgctgcctggcacacccggcgggcatctggcggagatcgcggcgcgctttcccgaccggccggcgatcgagggcgagggcctggttctggactatgccgggctggatgcgcgggtgaaccgcaccgcccgtctgctgacggcgcgcgggctgggccgcggcgaccgcatggcggtgctggcggaaaaccggttggattatgtggtgctggccttcgccgccgcgcgcaccggcatcatccttgccgccctcaactggcggttatcggatggtgagctcagccattgcgtccatctggtggccccgcggctggtgatcgcctcgccccggttccgcgacaccgcgcgccggctcggcctcgacccgctggtgttcggcccggactgggaagcggcgctcagcgccgaagaggcaggcccgatcccgggcgccgaagccgaggccgaagcccgtcaggaagacgggctgctgatcctttacaccagcggcaccaccggcctgcccaagggcgccatgatcagcgcccgggccgagatggcccggttcaccctcagccggcgggaactcgggctcaggcccgagcatatgttcgtcgcctgggcgccgatgttccacatggtctcgatcgagcatgcgatgcatgtgctgatgaccggcggccgggtggtggtggtcgacggggccgacatcccgcggctggtcgatctggtcgagaccgggccgcattggtggctggtgctgatcccgggcatgatcgagcgggtggcggccgagatccgcagccgccgggccgcccggcccgactggcggccggcacggatcgagatggtgggcgcgctggccgatctggtgcccccggcactgatcgccgagatttcgggcgtgctggaagcgccctactggaacagtttcggctccaccgaaaccggcatgctgccggccgccggcacccgcttcgcaccgggcgaggcgcccgccgacctcgccaaggccccgaacagcctgcatctctggcggctggtcgacgaggacgaccgcgacgtgccccccggcacagcgggcgagatcgccgtgcgcggcccctcggtcttcagcggctactggaatgcggccgcgacgaatgccaaagacttccgcggcggctggttccatatgggcgacatgttcgtggagcgccccgacggccggctcgatttcgtcgaccgcgccaaatacatgatcaaatcgggggccgagaacatctatccggtcgagatcgagcgagtgctgatgacccatcccgccgtgggcgaggcggtggtcgtgcgccgccccgaccagcgctggggcgaggttccggtcgccttcgtggccctggcggacgaggcccccccggtgacggcggcggagctgaccgcctggtgccgggcggggctcgccacctataaatgcccgcgcgagatccgtttcgtcgcctcgcgcgacgacttcccgcgcagcaccagcggcaaggtccagcgcaagacgctggaggcgcagcttcaggccgaaaccgcgccccccgtcgcccgcgatgtcgtcggggagagtgccgcatgagcacgatcatcctgcaccattacgactattcgcccttttccgagaagatccggctgatcttcgggctgaaggggctggactggcggtcggtgatcgtgccggcgatcaatcccaagcccaagctgatgccgctgaccggcggctatcgcttcacgcccgtgatgcagatcggtgccgacatctattgcgacacccggctgatcgcccgcgagctggagcgccgctttccgacgccgccgctcttcgccagcctggccgaacagggcctggccggggtggtggaggcctgggcggagcgcgacctgttctggccgctcgcccgctatatcagcggggtcaatgccgaacgcacggagccgggactgaatgccgatcgggcggcgttgcgcggcaagcccgagccgtcgctggcccggctgcagcaggtggcgcgcgacagcctgggccaggcgctgggcgagatccgccgggtggaccagatgctgggcgacggccgcgatttcctgctgggcggcagacggccgggcctggccgatcttgcggtctatcacggcctctggttcctcgacgccctgccgatccgctgcggcaccgcgctcgacctctaccccgccatccgcgcctggatggggcgggtggcagccctcggccatggccgggaaagcccgttcacggccgaacaggcgctggatgccgccgccgccgcctatccggatccgctgctcgcctcggccgacggggcagcgccggcgccgggcagcctggtcgaggtgcggcccgaaggctatgtgaccgagccggtgaccggcgagctgatccgcgccgatgccggccggatcagcctgcgccgcatccatcccgccgtcggcgaagtaatggtccatctgccccgccagggctatgtgctccgccccgccgggcatggtggccataccctggcaaccgccctggaagaccctgtcggagaggaagcctgccggtgaccaccctgctcgacggcaagatcgccctcctcaccggtgccgcctcgggcatcggcgccgccaccgcccgcgccatgctcgacgagggcgcgcaggtgatgctcaccgatctcgacgccgcccggctcgaccgtctggcggcagagctggccgaagaccatccgggccgggtggccgccctgccccaggacgtgaccgacgaagccggctgggaagtggcgacggcggccgtggccgaccgtttcggcccgatgaccgtgctggtcaacaatgccggcgtgctgccggaactctgccggctggaagacaccagcctggccgaatggcggcgggtgatgacggtcaatctcgacggcgtgttcctgggggtgaagcacggcatccgggcgatgaaggaccggggtggcgccatggtcaacatctcgtccgtcgccgccatgatcggcatgccgatcaccggcgcctataatgccagcaaggccggggtgcacatgctgaccaaatgcgcggcgctggaatgcgcgcatctgggctatgcgatccgggtgaattcggtccatcccggctatgtccgcacgccgatgaccgggcagatcgccgacacgctgggcggcgaccgctttgaccggcggatgacggcggtgacgccgatgcggcggctgggggagccgcgcgagatcgccgatgcggtggtgttcctggcatcggaccggtcgtcctatgccaccggcacggcgctcgtcatcgacggcggctggaccgcgcaatagccccgggtggcggggcctggaccagagggggaggttcggggcaggatcgggaacgtcccgcccctcctccggaaggcccgcatccccatgtcccgctcgctgcccctcgccggcctcgccggcgccgcctgcctgatcggcgccacgctggccctcgcgcccgcgccggccaaggccgaagaagtcggctgcgtcagcaccaccttcaagctgatcggccccaacaacaagatctgcatcgacagcttccgcgaccccaaggtcgacggcgtggtctgccatgtcagccgcgccaagaccggcgggctgaagggcgccgtgggcctggccgaagacacctccgacgcctcgatcgcctgccgccaggtcggcccgatcaccatccgcgaaaagctgaaagagggcgaagacgtcttccgcgaaagccgctcctggctgttcaagcgcctccaggtcgtccgcttctacgacgagcccaacaacaccctggtctacctgacctattccgacgaactggtcgacggctcgcccaagaacgccatctccaccgtgccgatcatgccgtggccggagaagtgaggcggcgcgccggctgcggcatgatcatcatgtgtcatccacccgcggcaattgcccgccgccgcgcggcggcatagtctgggcggcggttctggcgcagacgagagaaggcgcaggcggatggaaatctggatcatcctcggcatcgtggtgctggtggcgctttatgccatcgccacctataacggcctggtcgggcggcggaacggggtgcgcaatgcctttgcccagatctcggtgcagctgaagcgccggcatgatctggtgccgaacctggtcgccgcggtgcgcgatgccatggcgtttgagcgcgagaccctggaagccgtggtcgccgcgcgcggcaaggcggtcgccgcaacccagcgggcggaacagggtggcagtgccgccgatcgcgcccaggcgctggcggcggaacgcgaactgggcgccgggctcggccggctgctcgccgtggtcgaggcctatcccgagatccgctcgggcacccatgtgtcggagctgaccgaagagctgcgctccaccgaaaaccgcatcgccttcgcccgccagcattacaacgacagcatccagtcctataacgaccgggtgcagatgttcccctcgaacctgatcgccggcatgttcggcttccggaccgaggaattcttccaggtcgatgccgccgagacggcggtgccgaccgtgtcgctgcgctgatcccatggcccgcggcaaaggctggcggccctggcagaggcaggtctccccctgggcgcgccggggcccatggaacaccggcgccgacacgaccccgcagacggatccggccaccgatcccgtcccggatccgatacgcgaggcggaagaccggccggaaccggtcgagggcatccgtatcgaccgcaccgatttcaccggcgccatccgcgccaaccgccgcaaaagcctggcgatctgcctggggctaaccctgttcggcatggcgctcggctacctggtcggctggtgggtggccccgccctatgtgcccgaaggtgccggcctgctcgctgtgctgctctcgggcggcggcgcggtgggggcggcggtgatggcgatggcgggcgggctctggtccacgttggcactcacaaccggtgatcgcatggcgctcggcatcgccggcgcccgcgaggccgacccgatcgccgatcgccggctgcacaacgttgtcgaggaaatggccatcgccgccggcctgcccaagccgcgggtgatggtgatcgagaccgacatgcccaatgccttcgccgccgggctcacgcccgaaaagggcacgatcgcggtcacccgcgggcttctgaaccggctcagccgcgacgagctgcaggcggtggtggcgcatgaaaccggccatctcgccaatggcgacagccgctatatggtcgtggtgtcggtgatggtcgggctgatcgtgatcgtggcggcgatggcgcggaacatggcctatttcggcggcggctcccgccgcggcagcgaccgcaatggcggcaatgccctggcgctggtggccctgctgctgatggtggtcgcgatcctggcgcccttcgcggcgcaggcgatgcagttcgcgctgtcacgccagcgcgaatatctggccgatgccacggcggtgaagctcacccgcaatcccaaggcgatgatcggggcgctgatgcggctcgacgaagcggcggccgcaaccggccgcgatgcgcccacctccgcccgggcgctcgaagcgctctggatcgtcaacccgctcgacgggcccggcgaaagcggccgccggcgccgccgggccgggctgttctccacccatccctcgatcgacgaccggatcgcgcggatccgcgcaatgggttgagccgcagccacgccatcagcccttcacacaatggcgcggccccccggccgtcccggtctcgtcgatctccgccagctggcggcgggccggcttgacgtccagcagcggcgtgccgtccagacagtccaggccgcggaccagcagcgtgcagccctcctgcccctccagcgtcacctcggcggtgccgatcgggttggggcggttgggggagcggatcgagaaggtgccccgcgtcgcgccgctatggccggggttctgcaccaccagatcccgccttgcccggtcgagccagtagagcagttccagccgtgcgaaatcccccagccctgccagcgccggcgcccagagcgggtcgatctccacccggcagagggggccctcccccgcccggccctggcgcggacactggccccggccggtccagggggtgcggatccggccgatgaacaccagtccggcatcgtcgggcgccggggcggtcaccgtctcttccaacggacgcagatcgatctccatggggcacgggcctccagtcgcggggtgaatgccgtccgatcatgcgcggatggttctcgattgcaaagcgtcggcggcacgggttgaatcaccgggcttccgccccatctggcgaaagccccccagggtccggttccggacgtcgaaacagcggcaggtttgagatgcaggaccaggaatcgcccgccacccgcaagaccatgctgctgaccggcgccagccggggcatcggtcatgccacggtgaaactgttctaccagcatggctggcgggtgctcaccctctcgcgcgcgcccttcgatcccgaatgcccctggccgggcgggcgggaaaaccacatccagggcgacctggccgaccccgaggccttcgaggcgatcgcggccgaggtgcgccgccgcctgggcggcggcgggctgaacgcgctggtcaacaacgccgccatctcgcccaagcgggcgggcggcgcgcggatgggcgtggccgataccgactacgccacctgggcggcggtgttcaacgtcaacctgttctcggcggcactgctctcacgcaacctgctgccggaactgaaggccaccggcggcaccatcgtcaacgtcacctcgatcgccggctcacgcgtgcaccccttcgcgggcgtcgcctatgcctgctccaaggcggctctggccacgctgacccgcgaacaggccttcgatttcggccgcttcggtgtgcgggtaaacgcgatcgccccgggcgagatcgacacctcgatcctctcccccggcaccgaagacatcgtccgcacccagatcccgatgcagcgcctgggcgaccccaaggaagtcgcccgcacgatcatgttcctgtgctcgccagacgcgtcctatatcaacggcgcggaaatccacatcaatggcgggcagcacgtctgacgggcctgaaacctgccggaaaaacccgggccctgcccggaaaaagaagaggccggcgcccctgaaggcccggcctcatgatctttgtccatgagggtccggtttcccggaacgatccccacagcacatgatcagaagttagcgatggggagggcagattgcaaccgccgttctcttgcatgcctgcaacgctctcgtccatcgaggccgcgatatctcccgcccgcctcggtcgctatatggctgccgcacaaggcgacaggaatctggcacttcgtctgtgcgtctggaatatcagcctctgcgaggcgctctatatgccggtccagtttgcggaagttgcgcttcgaaacgccatatgcagagcacttgaaacacgctacggagcagggtggccgcataacggtgcttttctctgcacccttcctatgcgtctgtctgaagaattaaacagagccggcgagacggaaaggcaacttcaccgcgaccgaacgacacctgaccacattatatcggcgctgtcattcggattctggctccacacgctgaccacgaactaccggggaagtctttggcccatttattttccatctccttcccgaacaagcctcaaaatatcacgctgagagatgtccatagacgtgctgatcgactacgaattctgagaaaccggatcgcccaccacaaaccgatctttgaccgtggccctgtgtccgactacgacaacatcatcacgctgatcgagtggatctcggacgaaaccgcgtggttcgttcgccagaccgcccgcctcagccagacgatcaatcaacgtccacaatcatgaccatcccagacctatcgcgcgggcggccccctcccgattgtcccacccccgcggccgcgctatggtgccccccgacgggccggcggtcatgatcccgccggccggccgcaaaaggacgcgccgatgcagccgaccgatatgttcttcgactacaccctggccgccctgcccgattatctgggcttcctcggcaccatggcggtgctgatcgccgtcttcacggcgatctatcaggcgattacgccctatcgcgagatccggctgatccgcgccggcaaccgggcggcggccatctcgctctccggcacgatcatcggcctggccatcgcgctcaacaccgtggcggcgggggcggtttcgatcctcgacatggcgctttggggcgccatcgcctgcatcagccagctggtggtctatctgatcgtcgcccggctgctgggcgatctgtcggccggtatcgaagacgaccgcctcggctatggcattctgctgggcggtgtatcggtcgcaaccgggctggtgaatgccggggcgctgacctattgaacctgaagccctcgtttcagggcccgacgatccccatctctcgctcatcctcccccaacgcacgaggttgctccccgatgcgtcgctcccgcgccgtgaccaccctgctcatcgccggtaccgccctcaccctcgccggttgtggcgaagacaccgaacaggtgaagatctacggcaccagcgaggcctgcagcgccgagatgaccgccgccgactgcgccgccgccgaggccgaggcccgcgaggcgcatatcgcgaccgcgccacggttcgacagcctggccgcctgtgaagaggatttcggcgccgatggctgccagccggtgccccagcagcaggcctcgtcgggcggcagcttcttcatgccggccttcgcgggcttcatgctcggccggatgatgggcggcggcgggggctttcacggccgcccggtttatgtcgaccgcaacggctacatgtacagcggtgccgaccgcttcgggcagacccggcgcgagaacgtgttccgcaacggccggccgaccaactgggcgggctcggccaatgtcgcgcgcagcacggtcagcaacccggtgaagcctgcgggtacggtgtcgcccgcccggcgttcaggcggcttcggttcgaccggcgcccgcggctattccttcggcggctgacggagacatcccccatgcgccgcgtcacccacccgccccgccccgactgggcccgccggatggaagaggagctgggcttcgtcttccactcccccgacggcacggtctattgggacgagaccgcccattgggcgttcaccgaagacgagatcgaccggatcgaggatgcggccgacgccttccatgcgctcgccatccgcgccgccgatcgcgccgtttcccagaaccgtctgacggagctgggcattccgggctatgcggtggcggcggtggccgacagctggcgccgcttccgcgagggcgacccactggaagccccggtctatggccggctcgacatcgcctggaccggcgagggcgcgccggcgctgctggaatacaatgccgccacccccaccagcctttacgagacggcggtggtccagtggcactggctggaagagacccatcccgaggccgaccagttcaaccgcctgcacgaagcactggtcgaggcctgggccgcgcgcggggccgccatggccgggcggccgatccacttcaccgcgggcgatgtggccgaagacatggcgacggccggctatctgcaggcgatcgccaccgaagcgggactcgccaccaagctggtcgcgatcggcgacatcgccttcgacgagagcgaccgccgcttctatgacccggacggcacgccgatcgaggcgctgttcagcctgtacccggtcgaatggatgctgcgcgaagactggggcgtgcccctgatcgaggcggtggagaccgggcggctggtgctgttcgaaccgctgtggaagcagctcttctccaagggcatcctggccttcatgtacgaactggagcccgaccatcccgggctgctgaaggcggggttcgcccccggcctgttcgccccgggcgaccgggtggtggccaagccgctcgccggccgcgaaggcgatggcgtcgagatcgtgacgcttggccccgacggcatgccggcggccgacagcgtggtacgccaggcaagccccggcccgcgcatcgccggcgacgagggctgggtctaccaggccttcacgccgctcgcccccgccccgggcggccatgcggtggcgggtgtctggatcatcggcgacaaggccgtggcgatgggtctgcgcgaggatacgggtgagatcaccggggtcggcagccgcttcgtgccgcatctgttcacgccgcggaacgcgtaggccgatcggggccgcccggcgggatcacccccgcccggcggccacccgccgcagccggacgttccaccagatgatcgccggcaccaccagcaccgtcggcaccagccaggtggcgatcgggggcaggccgagggtcgggccgttgacgaccagcgcggcggtgatggtgccgatcagcgcgcccatcatgcgcgaaaggtgacgggcgatgcgcggcgggccgacgcggctcacctccatcaggtcctggcaggcgagcgcgccgccgatcaggccgaagaccggcatgacgacattggctgccccgcccaccgcaccggtcaggccggcgacgatcatcaccagggccaggcccagcatcaacccggcgatcagccggtcggccatgcccggctccgccttgcgacggcgggcggcccgccagccggcggcgagcagataggccgaaaacccggcaatggcgagcaggaaggacgagaagttcaccagcgccagcaccaccgaggcggcaagcgatacggccatcgaccagccgaatacccggccgatccgtcggtggcggtcattgcccttgcccggcaggaccatcagggtcaagccgctcgccagcgccagggcgcccgcccccacatgcagcaccagaaacgccgtcgaaatcatgcctgccccgttgcgatattttaccgccgcccatcgggcagctgcggcttcatcataatggtaccgccgtgccgatgcttgtgcgatcgaacacggtttgagtgagttccgtgtaaaatgccctctccgccggtcgtcagctgcgacggcgaagttcggtcggatctcccaaagcctggaggcgacgggcgacctcggcgcagtcgtcgtcgatccgggcgggtacgtggagcagtgcctccagatgggcgtcgtcgaagctctcgaccggcacgccctgagcgcgggcgatgcgatggctgcgcaccagcccgggcagataggtctccagcgaacgggccgaggtccggatgctcatcagcggcgtctgcaccatgcgcccggcggcccggccgctttcggcgagcgcccgttcgcgcaccgcccgggaattggcggcgttgtagttgaaaatcgcgccgcccagcaggccgaaggccaggatcggggcgtattcggcatagatcgccacgtcgtgttcgggcggaccggtgatcagggccatcgccaccccaagcccggtgccgatcaggaacagcatgatcaggctgaaccagtcgaccagcagcaccagaaggaacagcgccgtcagggtcgacatctgccagatgaccgaaccgccgttcatcaccgtcatgaaggtgaagaagaagggcaggcaatagcccagcatcaccagccagacagccgggatccagggctgcagccgcgccggccagcgtcggcggaaagcaagcagcagacacagcaccgacccggccaggcgcaggccgagattctcgtaagcctggggaaagaggaaggtccagaccatccaataggccggcatcatcaccgcaccggcgatcgacaccggcacgagattgggctcgatatggcggaaaccgttcaggatgatgccgcgcaggctgccggccgggacgtcggtgccggggcgcgcggcctcgccagccggcctcgggtcggatcggtaggtgctgctgcccgacatggtcttcagcccatcaccgtgctggggcccgtcggcatgccgccccggcccttgtcaccacgccccttgtcaccgcgtcccccggcgcgcggatcggcaccgccgctcagccggccgccggcgccctggtcgctgatccccgaatgcggtccgccgcgtcggccactacccaccacacgcgccgccggccaggcgatctcggcacgggttccctcgttcacccggctgatcagctggaagcgaccgccatgcatctcgatcagcgaccgaaccagcggcaggcccagcccggtgcctgcatagcgacggttgagcgcactgtccacctgtccgaaggcctccatcgcccggttgatgtcttcaggcgcgatgccgatgccggtatcgaccaccgcgatcgtcaacccgccctcctcggcaatccgcgcctctaccgtgacactgccgccgatcggggtgaatttgaccgcgttcgacagcaggttcagcagcacctgcttcatcgcccgctggtcgccgcgcagcgccggcaggtcgggtgccagcatgttgaccagtttcagcccggccttgtcggcctggccgcgcatcagattggtcgtggtccggacgatgctctccagcgtgaagacgctttcgtccaggttgtaggcgccggcctcgatcttcgacaggtccagaatgtcgttgacgatgtcgagcaggtggacgccgctttcgttgatcagccgggcgaattccatctgctcgtcgatctgggcgtcgttgcgcggccgatcgttcatcaggatctccgagaaaccgatgatcgcattcagcggcgtgcgcagttcatggctggtattggcgaggaaatcggatttggcgatgttggccgcctgggcagcctgcaccgcatcggccagttcgatccgcaggcgcagcccgtcgtccagcaaccgtgccagataatgcgcacccaccgccaatacggctgccgatgcggcgatcgccagcagcagcggcagatccatccgcccggcgatgatcagcccgccggcaagtgccgttgatgtcacccccagccagaccagagccgccgtcagatgacaggacatcatcaccgtgccggccacaccgatcgcggcggtggcgaacaataccttggccatgtcgatcgaggcagcggcaggcgccagcaccagcggcgccagcccccagatcacaccgctgaccgcgatgatcatcaggatcggcagggcgcgttgttcgggttccgtgtcggcaccgccatcacgcagatcacgctggatggcggcgaagcgcaggcccaccagacagttgaccgccaccagccagagcgcgatctgctgctgggcggcagcgggccagatcagcaccgccaggcagatcgagaccagcggttccataaggatgccgatccgggcggcgcggtagagcgcatcgagctgcgcggcgcgcatgcgcgccgtcactgtcgccgcctgaccctccgctccaccgtcccgccgcaggttcatgatgtgccgatatgccctctatcccggccattgaaacatgtccggccattatggcgggattcagtgcccttggcgatggagcgttgtgagcagagccgtggatgcacctgatgcgtgtatgtctcacaggcatataaaattaaaacgcataaaattctttgaaactgcgaaaatccccggccccgacgcaaagccgggaccggggaccatctgtccgaaccgtcattccgccgcctgtaccaccggccccggcctctcccacgcggccaacaggcgccgttccttcaggcgaacccgtttcaggttctcgtccttcacgtgaccgaagccccgaatatccatcggcagcttcgcgatctccaccgcgcgggcgtgattttcgggcgtcaaccccgcgaccagccgttccaccgtggcacggtattcggcgatcagccgccgctcgatcctgcgctcggcggtatggccgaaggggtcgaagacggtgccgcgcagccgcttcatccgggcgagcaggcggaaagcccccatcacccagggaccatagctcgatttgcgcggccggcccgtggtcttgtcgcgccgggcgaaaagcggcggagccaggtggaaggtcagcctgacatcgccctcgaactgccgcgccagcttgtcgtggaaggcgccgtcggtgtaaagccgcgccacctcgtactcgtccttataggccatcagcttgaacagcgaccgcgccaccgcatcggtcagcgcggtgctgcggggcatcacccgcatctcgtgctggcgcacacgctccaccagttcggcataggcgccggcatagctggcgtcctgataggcggtcaggaaaccggtccgccgggccatcacctcgtggatcgtttccgacagccgctcgctttcggccaccggccggctgcgcgccaccagatcccgcacccggcggatatcgtgggccgcacgccgcccccagaggaaggcatccaggttgagcttcaccgcaacaccgttcagctcgatcgccttcaggatgctggcctcggccagcggcaccagcccgcgctgccaggcatagcccagcaggaacaggttgctggcgatgctgtcgcccagcagggccgtcgcgatcggcccggcgtcgatgaaatccacccccccagggccggccgcccggcgataggccgcgcgcagatcctggccggggaaagccaggtccggatccttgacgaaggccgcggtcatcaactcctggtcgttgatcaccgcccggctgcgcccgggatccagcagccccagcgcatcggggcgcgcgcccaccaccagatcggcggccagcatcagatcggcaccgccggtggtgatgcggatcgacttgatgtcttcagggcgctctgcgatgcgcagatgggtgaagaccgccccgcccttctgggccatgccggtcatgtcgagcacgccgacacccttgccttccagatgggcggcaacgccgatcagcgcaccgatggtgaccacacccgtgccgccgacaccggcgaccagaatgccatagggccgcgcccccagcgccggcagctccggatcgggcaacacctcgaagggggtggcatcggcggtcttgggcgcgggcttgcggatcttcgcaccagagacggtcacgaagctggggcagaagccctgcaggcacgacagatccttgttgcagttcgactggtcgatctggcgcttgcggccgaattcagtctccagcggctgcaccgacacgcagttgctcttggccgagcagtcgccgcagccctcgcagaccagatcgttgatcaccacccgccggtcgggatcgaccagggtgccgcgcttgcgacggcggcgcttttcggtggcacaggtctgctgatagatgatcaccgtgcagccctcgacctcgcgcagcatgcgctgcacggcgtcgagttcgctgcggtcatggaccgtcacgcccgccggcaggccggcgccaccctcgtaagccgcggtgtcgtcggtcaccaccaccaggcggcgcacaccttcctgaagcagttcatgggcgatctgctgcacggtcagcgaaccgtcgatcggctggccgccggtcatggcgaccgcgtcgttgaacaggatcttgtaggtgatgttgaccttggccgcgatcgcggcgcggatcgccagggatcccgagtggaaataggtgccgtcgcccagattctggaagacatggggctcggtggtgaacggcgcctggccgatccaggatgccccttcggcgcccatctgggtgaaggtctcggtgcgcggcatcacccaggtcgccatgtagtggcagccgatgccgcccagcgcccggctgccctcgggcaccacggtcgagctgttgtgcgggcagcccgagcagaaggtgggcttgcgctcgatcgccgccttgcccgaggacgcgtcctccagctggcgcagatgtgccacccgggcacggatacgctcggccaggccaggctcgtcgggcaggaagcgggccagacggtcggccaggacctgggcgatccggctggggcgcagctcccccgccgagggcaggatccagttgccggcctcgtcgaacttgcccaccaccagcggccggacatcggcgcgccagccgtagagatgctccttgagctgcggctcaaccacggcgcgcttctcttcgacgaccagaacctcttccaggccctcggcgaaacggcggatgccttccggctccagcggccagggcatggcgaccttgtagagccggataccgatccgggcggccagggcctcgtcgatgcccagctcgtccagggcctggcagacgtccagatggctcttgccggcggtgacgatgccgatgcgggcgcgcggcgcgtccatcaccacccggtccagccggttggcgcgggcgaaggccgcgaccgccgccagccggtagcgatggtgccggtattcctgatccatcggcgcatcgggccagcggatatgcacgccatcggctggaaactcgaactccggcagcagaacccgcacccggccggcatcgacatcgatcgagcccgagctgtcgaccgtgtcggcgatggtcttcatccccacccaggcacccgagaaacgcgacagcgcccagccgatcaggccgtaatccaggatttcctgcacacccgacgggttcaggatcgggatcagacagtccatgaaggtgtattcggcctgatgcggcagggtcgaggatttggcgccgtgatcatcgccggccagcagcagcacgccgccatggcgcgacgagccggccatgttgccgtgcttcatcacgtcgcccgaccggtcgacgccggggcccttgccgtaccacatgccgaacacgccgtcgtatttcgccagcgccgcatgttccggccgggtcagattgtccatattggcctgctggctgccccagaccgaggtcatcgccagatcttcgttcacccccggacggaagacgacgtgatgcgcctccagatgcttgcgcgccttccagagctgctggtcgagcgtgcccagcggcgagccgcgatagcccgagatgaagccggcagtgttcagcccggcggccaggtcgcgctggcgctgcatcagcggcaaccgcaccagggcctgggttccggtcagaaagatccgtccgcgctcgacggtgtacttatcgtcctgcgacaattcgggcagcgtcatttcggcgtctccacacgacatcgtccccgcctgaagcggatccccgggtgatggccccgccttcgccgcaatcgatgcgtcgggcatcgatgcgccgggccgggctcgtcttgtcgatgctgaccggcctcgatgccggcagatcaaattaggtcagcattagtgacctatttttccggttatacgatggatgcaggtgatgccgcaacatccttgtccgaggggaatagagcgcggatttttcagggtttcccgaaagaaaatccccgacatccctcaaaaatcatgcggaaaattatcgcgcgacacctcgtcggtgcgaggcgcgacctgacccacgatcacaggccggcaggccggtcggcagcagcccgggcgcgcctcagaaccgcttcggccccctccagaaagagttcgacgccgaaggccagctgcgcagcgccataggtgtccacccccagaccggcgatccgttccagattgggaaatccgggcggtccgacctcggacagggccgtgcggagtgaacgggcacggggtcgttccgtctcccggcccgcctggacgatgtcgcgcgcatggccgagacagagggtggcgagcatggtcaccatccgaacggcgtcttcgtccggaaaaccggccgcgttcaactgagcgaacagcgcctcggccggttccagcgcccaggcggtcaccgcttcgttgaaccagaggtattcggacaactcccccagcgatcagcacctgatacgggtccacgagaaggtggccggggaggtcatcgatgtcggcgcgcccgagatcggcggctaccgggccaattccccgcgcgaatcgatgtgggccgcgctgaccgagatgcattccatgctctgggtctatgaacgcctcggcttccggggcctccggctcccgcggcgcctctcggccgaggaacgggatcagtacattcgcgaggtcagcgactactgccgtctgttcccgcacgatgaagcggatctccctgcctctatggcagatctgcaagcgctctaacaaaaaatatgaccacctcttcggtgtcacgaagacgctcagcatcattccggaaacgggcgacgacttccatgaattgtggaaatcgtcgattcagaagaaccatcacccgtcacagcgcaaggtcaaacgccagctcttctcccaggaaggcctgttcaagctcatcgccatgagtgccgtctcctcgaagacacgccgcaacagcggcgtgacgccgcgccgggaaaagatgatcctggcggcacgcttcgcgatgatgccgttgatctggctgctccagcgcggcccgatcgaacgctattttctgaggatgatgtggggaccggacgcggtcgatctggtcagatccgcgcgcaggctgcatgcggatgcaaaacgggcacggaagcactcggcccgtcaggcgcgctacgcctgacgggccgaacggacggatgccggcgcagcgggcgggctttatgcccgcccgcgtcttttcgtcccggctcaatcggtgccgtcgagacccagatcgcgcagcttgcgatagagggtggaccggccgatgcccaggcggcgggccatctcgctcacccggccgcgatactggcgcagcgccatgcggatgatatcggcttcaatctcttccagcggccggatatggcccgcctcgtcgaaggcgcggatcggcgcctcggcctcgtcgtcgcgcgggcgcagaccggctgccggcagcgagccctggggggccggcggcatcggcgcaggcatcggcgcctgggcgaagccctggggcatcatcggggccggctggccgccgcccgccgcgaccagcatcgggcgtcccaccggcatctgagtaccgggcatcggagtacccggcatgggcgcaggcgccatctggccccccgcctgcggataggcaagcccgcccggcgtcggcgccagcgacggctggccgccgggcccggcatagaccggcggaccggcgccgtaatcgccgggcagcgcggtatcgccgaagccgttggcacgataggccgcctgctgaacctgggggaaatgctccacatccaggatgtcgacatccgacagcacgaccgcacggaagatcgcattctccagctggcggacattgcccggccagtgataggtggtcagcagccgctccgccgcctcggtcaggccgcggatccgcttgccctctgccgcctcgaagcgctggatgaaatggcgagccagaaccaggatgtcgtcgcgccggtcgcgcagcggcggcacatagatcggaaagacgttgaggcgataataaaggtcgtcgcggaactggccggtctggaccagatcccacagattgcggttggtggccgaaatcagccggatatcgatcggcaccggctgcttggagccgacggggtcgatttcacccgcctgcagggcgcgcagcagcttgacctgcagatccgggcgcaactcgccgatttcgtccagaaacagggtgccgcccgaggcctcctggaacttgccgatatggcgctcgctcgccccggtaaacgcccccttctcgtggccgaacaacagagtttcgaccagattttcggggatcgcgccgcaattgaccgtcaccagcggcccgtgggcgcggtcgctgcgggcatggatcgccctggcgatcagctccttgccgacaccgctctcaccctcgatcaggatcgggatggtcgaattggccgcccgcgccaccaggcccagcacggcgcggatcgcccgactgtcgcccagaatatcggtcaccggcatcggccggccgcgccgcggcgccacgccgtccagatcgtcggcgacgccgggacgcagcgcctgacggatcgcgatctgcagccggtcggccgagaccggcttgaccatgaaatccgtcgcaccggcccgcatcgcctgtaccgccacatcaatgccgccatgggcggtgaaaaccagaatcggcagatgcggccgggtgggccgcacctggttcagcacgtcgatgcccgacagccccggcatggtgaggtcgagcagtaccgcatccacccgctcgcgccccggcatcagcaggcgcaccgcctcctcgccgctgcccaccggccggggccgatagccgaaacggccgatcgtcgcctccagcagccggcgctgagcggggtcgtcatcgacgatcaggatggtgggtgtcatatgatggatgcgccgttccgatgccgtggacgggcggccggaaacccggccggccgcgagagactgcatatttaatcagataagcgtatcacgtccatttaccaagttggccaacgccaacggcgcgatgggctgatggctggggttgacctgtgacggttcattgaaatcactggcgcatgtccgttcgggttggtcggctccgcccgccggcctatattgtgtccaccacgacgacacggttccttgaggagcagccttcccatgcccgacggccacgagccccttcgccccgagatcggcgatctgccccgctggcgcctcgacgatctttatgcggccccggacgatccggcgatcgatgccgatgtcgccacggcacgtgcggatgcggaggccttcgccacggcccatgaaggccgtcttgccgagcttgcccccacggccctggccgatgcgatcgaaacctatgaacgcatcgaagaggcgatgggccggatcggctcctatatcgggctgatgcacgtcacccgcctggaccaggccgaggccgggcgccgctatcagacggtgtcggaacagctgaccgagatttcgagccggctgctgttcttcgtgctggagttcaaccggctggacgatgcagcacttgccgccgcctacgaggccgagccgcggcttgcccgctaccgcccctggatcgagcggcagcgcgccttccggccgcaccagttggaagaccggctggaaaagctgctcctggagaagtcggtctcgggccgcgcggcctgggtgcggctgttcgatgaaagctgggcctcggcgcgcttcaccatcgacggcgaagaactgacctcggacgccgtgctctcgcgcctgggcgatcgcgaccccgagcgccggcgcaaggccgcggccgccttctccgaaggtctgggccagcgcatcccgatgctgacgctgatctacaacaccgtggtcaaggacaaggagaccgaggatcggtggcgcggcttcgcccggccgatctcgtcgcgcaacctgtccaaccaggtcgaagacgaggtggtggatgcgctgatcaaggcggtgcgagaggcctatccgcggatctcgcaccgctattatgcgctgaaggcccggctgctcggcatggagaagctgaactactgggaccgcaacgccgcctatccccaggatgccgatgccgcgatccactgggaccgggcgcgcgagatcgtgctcgacgccttcggtcgcttcatgcccgaaatggccgagattgccggccggttcttcaccgagaactggatcgacgcgccggtcgcccatggcaaggccggcggcgccttctcgcatccgaccgtgccgggcgcccatccttatgtgctgatgaactatcagggcaaggcgcgcgacgtgatgacgctcgcccacgaactgggccatggcgtgcatcagacgctggcggcgcatcagggcctgttcctgtcggaaaccccgctgacgctggccgagaccgcctcggtcttcggcgaaatgctgaccttccgcgccctgctggatgccgagaccgacccgacccgccgccggctgatgctggcctcgaagatcgaggacatcatcaacaccgtggtgcgccaggtggccttcgccagtttcgagatgaaggtccacgacgcgcgccggtcgggcgagctgacacccgaagatctgggccggatgtggttcgaggttcagaccgaaagcctgggcccggccttcgatttctcggaagattatcggaactggtgggcctatatcccccacttcttccacacgcccttctatgtctatgcctatgccttcggcgaatgcctggtgcacgcgctttacgccgtgcacgaacagggcgatccggatttcgtcgccaagtatcgcaccctgctcgccaccggcggggccaaggatcatcgcgaactgctggcgcccttcggcctggatgccggcgatccggcgttctggagccgtggccttcagctgatcgagggctatatcgaccgtctggaagcggaagtcgcggcggcgggtctctgagggcccggctgccgggcctccggcgccgcctgcccggaaggagcctcctcccccatgaccacgcccacctctcatgacgataccgccacccccggtggggtggcgggaacgtccgacgaagacgatcgcctgggcggtcggatccggcgctatgcccgggtcggcaccggtgtcggcggcctggccgcccggctggcgggcgagcgcctgttcggcctgccgctggatcgcggtcgccatgccgaggatctgcgcgcagccctgggcgggctgaaggggccgctgatgaaggcggcccagatcctgtccaccattcccgacgcgctgccacgcgaatatgccgaagaactggcccagcttcaggccgatgcgccctcgatgggctggctgttcgtcaagcggcgcatggcgaccgaactcgggcccgactggcgcagccggttcggcagcttcgaacgcgaggccgtggccgccgcctctctggggcaggtccacaaggccaccacccatgacggccgggcgcttgcctgcaagctgcaatatcccgacatggcctccgcggtggaggcggatctgcgtcagttgaagctgatcttcggcatctaccgccgctatgaccgggcgatcaaccccgaccagatccatgccgaactgtcggcgcggctcagggaagagctggattacggccgcgagggccggcagatgcggctctatgcccatatgctgcggggcgaacccgatgtgcatgtgcccgactggctgccggagctgtcgacgaagcggctgctgaccatgacctggctcgacggcgcccggctgatgtcgttccgcgacgcagatcagacggtgcgcgaccggatcgccatgaacatgttccgggcctggtacgtgcccttctacgagtacggcgtgatccatggcgacccgcatctgggcaactacgccgtccgccccgaggatcacgggatcaacctgctcgatttcggctgcatccgtgtattccggccaggcttcgtgaagggggtgatcgacctctatcacgcgctcgaccgcaaggacgacgagctggcggtggaagcctaccgcgcctggggtttcgagaagatcgacaagaccctgctcgaggtgctgaacacctgggccggtttcctctaccggccgctgctggaagaccgggtgcagcggattcaggaagaaagcagcggccagtacggccgcgcggtggccgagaaggtccatgccgaactgaagcggttgggcggcgttaccccgccgcgcgaattcgtgctgatggaccgggccgcgatcgggctgggatcggtcttcctgcatctgaaggccgaaatcaactggcaccggatgttccgcgatctgatcgacgatttcgatgtcaacaccctgaccagccgtcaggaggcagcactggcggcggtggatctggaccgtccggccgattgacgtccggtgcctgatcattggccggttccgcaggggccgccgcggaaccggccacctcatgtcattttcgtggcaggcgccccatatcgtggcccccgccgtgacattatgcggagtcgcagcggaatcagatggttacctcggttacataaaaagccgtcaaaatccttgatataaaaatcatggttaacagatggtttacgcttgcccagtgttccgggggccccatatgacccctcatgacggcggggcaaagacgggacatcgggaggggcaaaccatggttgtcgacggactattggccaccgaggccgccgcggccgcggcggcggtgctcgccgccttcagacttgctcttttgccgcacgaggatgcacgtatccggccgatgagccggattttcggcgtgctgatgggcatctcgatcctggccgggctggggcttgcgatcgtgcagccctcggttctgctgctgatcgtcaccctgcttgccatctataccctgatcgccggctggcgggccaccacccgacagaccgccgagccgtccaccgccgaccggatgatgtcgggcgtggtgatcggcaccggccttctgaccgtgatggccgggctgaccggcatgatcggccgcgaggtcgacccggcgctggcggcggtgatgccggttgcagccaacgtcgccctgccggttctgggcctggtcggcgccttcctggcggttcaggacgttctggaagaaccgggccgggtgcgggtcggccggcatatggtgcgcatgcttggcgcgctggccgccaccgtcacgctcgccctggtgctgcaccgccccttcgccagcctgggtggcggcatgatcgccgatggcgcccattggatggtgccggcggccgtcaccctgccgatgatcaccatgtggacgctgaggctgcgccgtgccgtggccgccatggcggccaggcgtcgcacgccgcaggaagcggtgaactgagacgccgtgagcccgtgagggcgcccgtcagccgggctggggcgcctgatcaccggggacggttctgacccgtgtcaggtcggcggctgccgcctgttcgcgcgcagctgccatgcgatgccccgcccagcgttcaaaatccgcggcatccatcggccgggcgatggcatagccctgggcgacatcgcagccccagctgcccagcagcgtcaggatttcctcgctctccaccccctcggccaccaccgagagccccagattgtggctcatgccgatggtcgagcgcacgatcaccgcatcctcgctcgccgccgagagatcgcggatgaaggactgatcgatcttcagttcctgcaccggcagccgcttcagatgggcgagcgaggaatagccggtgccgaaatcatccaccgagatcgtcacgccgctccgtctcagcccttccagcaccgcacgcgaccggtcggggtcggtcatgatcgcactctccgtcacctccagcgtcagccgcccgccctcgatcccctcggcctccaggctgcggccgacgaagcccacgagatccggatcatccagatccagggccgagatgttgaccgacagcccgatatcgagcccggccagccgccagctgcgcatccggcgcaccgcctctctgatcacccagcgggtcaccccccgggtggcaccgctctgctcggcgagcgggatgaattcggccggcgaaatcatgccataggtgggatgctgccagcggatcagcgcttccgccgccaccagccggccggtggcgacatggatcttgggctgatagagcagccggaactcgccatgttccgccgcatggcgcaggtcgcggatgagggcgatccggcggcgatggtcgtcgtcgcgcccggcctggtagagctggatccgccgcggcaggcgcgctgcatcctgcatggcgatcgccgcccgccgcagcagatcctcggccgtgcgcgcgtcgtcgggatggatcacgatccccacccggcaggcgatcgacatatcggtgccgcccacctgctggggcaccgcgaacagccgctggatgcgatcggccgcgatcatggcgcgcgcctggtcggtcccgggcatcagcaccaggaattcatcggccagcaggcgtgctgcgatttcccccggcgccagggtcgtctccagccgccggcccagctggcgcagcacggcatcgccgccggcatggccgatcgcctcgttcaccgcaccgaaatcgctgagacccagatgcagcaccgccaccggctggccgcgctccaccgccgcttccagccagtcttcggccgcccggcggttcagaagaccggtcagttcgtcatggcgcgccttgtggctggcttcgcgctcgatctccgccatgtgcagccgggcagcttcttcccggcgttcggcggcgaagcggcgctcccgttgctggttcatggaatcggccagaccgaaggccagcagcatcacctcgatcgacgagcccacgatcagcggccagatccggaaaccgctggccggcagcaactcgctcagctccagatagtgcagggccacggcgacgatcagggcgaagaaggccggcaccgtgaagcgggcctcgcgcacgcccttgaacagcagatggacgttcagcagatagaccaccaccaccagcagcaggccgatcaggctgaacgccaccgccagcacatactgtccgaaggccagcggcaccagccccgacagggctgcgatcatcaacaggctgaccgcccgtcgggtgatcaccgacacatggcgatgcagccggacatagcgcaccacgaacaggctgccggtcacgaaggccaggatgatcgatccggcggtcatggcgttgccgaaggccggcagatccggccagacatactgaaaaccatagccgcgatagctggcgctgccggccagcaccgccagcagatgcaggacatagaggccgaccggcccctgccgggtggccagaaagaccagaagattgaacgaggccagggccgcgagcccgccatggaacatcgacagcagcaggctttcgcgccctgaggcggtgaagaagccggtatagtcatagagcctgaacggcatcatcgcgaacaggccgtcatgggtatcgaagcgcagatagaccgtcacgctcgcatccggcggcagatgatagggcaatgccagatcgcgatagggcatgagccggctgtcgaagggccgccggtcgccgctttggttggccagcagcacccggccgtcggggtcggtgacgtaccagtccacataatcctgctgcgacgtgcccagatcgagcaccacccgcgccgtgcgggccgaggggttggtcagcgtcacccgggcccaccaggccatgtcgggggcatagccgaagcgcagaacccggttcggcgtagccgtccagccggtggcccggcgcgccgcctcgagatccatgccgccgcctgggtcgggcaggaggcgggtatagggcgccaggtcgaccccggccccgatgccttcggtcatcaccgccggtgcctctgcggcaatcgcggcccgcaccgcgccgccccccgccatcagggatgccagaaacagcatcccgatcagggcgaggcacaggcggcagcggaccgatcccggaggcatggtcaagcgcctgccggcgccgaggcttcggccagcgccacccagaaggcggcggcatcgcccaggaccgcatcgttgaaatcatagccggggttgtggatcatgcagctggtcggccccgactcaacaccattgcccaccaccagatagcagccgggaacgccctccagcatataggcgaaatcctcgctgcccatcgatgcctcggggatgtcgatcacccgtccggcaccgaaggcgtccaccgccaccgcacgcgcaaaggcggtcgcctcggcgtcgttgatcaccgccggatagccccggtccacctggacggtcgccgtcgccccccaggcggcggcctggccggcgaccagctcgcggatgcgcatctcgatcaggctgcgggtctcggggtcggtggtgcgcacgctcgccttcagcaccgccgtttcggggatgacgttcgccgcctcgccggcccggaacgcgcccaccgtcacaacggcctgccgggtgggcggcacgttgcgcgcgacgaccgattgcagggccagcacgatcgccgatccggccacgatcgggtccacggcccgttcgggataggcgccatggccgccgcggccgcggacggtgatcacgtaatcgtccgatgccgccgtcagcgcacccgggcggaagccgaacacgccggcaggcagccccggcatgttgtgcagggcatagatccgatcgaccgggaagcgggtgaacagcccgtcgcgcatcatcaccgccgccccgccgccatgctcctcggcgggctggaagatcacccgcaatgtgccgcggaagcgccgtcgttcggccaggcagcgcgcggccgccagcaggatggtggtgtggccgtcatggccgcaggcatgcatccggccgtcatgcaggctggcatggggcaggccggtggtttccgtgatcggcagggcgtccatgtcggcgcggatgccgatcaccggccccggcccggtggtcagggtgccgacgacaccggtcccgcccaggccttcatgaacctcccacccccaatcggccagcgatcgggccaccagcgcggcggtccgccgttcttcgaacgccagttccggatggcgatgcagatcgtggcgcagcgccaccatttcatgcagccaggctgcgatctgacggcctggtccactcggcttcgactgcggctggggggcggacatgaagcaacctccggttcaccacgatttgcccggatgagcataacaggatgcaatggccgcgcttcatcaaatcgccagacggaacaaccgcgctttaccgtcgtcgccgcaaattttacaaccttatgtatatgattttctgtcatttaattccgattagtcgtgactctttattaacctcaggtagaatgttgatgtttctacaacccccgtatggagggagacgccatgagcgacaatgtggtggacgtcagggagacggtggcgaagctcgggctggacgcgaaggagcccgacatcgcccttcgcaccgggctgaccggcggcaagacctttctggtccagatccgtccggccacccaggagaagccggtgctgatcgccgtgcatctctgagccggcgacatctgaacgatcgggcgccgacccggggctccccgggccggcgccttccccgccgacgccgaaggaagcccccgatgagccacgccgctcccgatccggctgcatcgcggatcgatgccgatccggcccccctgctccatggcggcatcgtcgctgccgcccagctgcgcgcgctgggtatcgggcatctcttcacgctgaccggcgggcatctgtcgccgctgttcgacggctgcgcccgcaccggcatccggctggtcgatttccgccatgaacaggccgccgcccatgccgcggatgccatggcccggctgacccgccaggtccaggtatcggctgcaaccgcaggtccgggcgtggtcggggccgcggtcgcggtcgccaatgcctgggcggccggcagcccgctgatgctgctggccggccgcaatcccggggccacggaaggcatgggtgcgctgcaggaagccccccagctcgacatgctgaagcccgtcacccgcatgaccgcgacaccgggcgatctgtggcgcctgcccgaattgctggcagaggccgccgccaccgccatggtgccgcggccggcccccgtggcgctggatctgcccttcgacctgctgatgggccgcatgccggccgatgcgctcagtttcgcgcaggggcgcggccagagccacgcccccgccgccgatccggatgccgtggccaagaccgccgccctgctccgcgccgcccgcacccccctgctgctggccggatcgggcgtctattgggcgggggtggaagaggcgctcgaccgtttcgtgcgcgagaccggctgcccggtcttcgccaatggtgccgcccgcggcatcctgccgccggatcatccgcagatgcacaatgccgcccgcgcccgcgccctgcccgcggccgatctgatcatcgcggtcggcatcgatttcgacttccgcctgaattacggccgcgcaccgctgatcgaccccgattgcgtgatcgtccatgtcgatgcagaccccgccaggctcggccgcaatcgcggcgcggtcatgggcgtcacggccagcccgcgccatttcctgaccgccctggcccaggctttcgaggccgatggccaccgggtgccggccgcctggcccgaacagcttgccgcccgcgatgccagggcggcccgcgcacgtcaagaccgcctggacggcgacggcccgatcgaccatgcccgtttcgcggccgaggccgcccggttcgtcacccccgacaccgtcaccatcggcgatggcggcgacgtgatcgccgaaaccgccggcgccattccggtcggccgcccgggccactggatggatccgggccccttcggctgcctgggcatcggcctgcccttcgccatcgccgcccgcctggcccggcccgcatgcccggtgctggcggtgcagggcgacggcgccttcggcttcaacgccatggaaatcgacagcgccgtgcgcgcaaagaccggcttcgtggtgctgatcggcaatgacggcgcctggggcgagatgcgcaatttccacgacgacattttcggcgacgccaatctcgacggccagttcttaagccgcgccacccgctatgaccgcctggccgaagcgctgggcggccatggcgagcgggtggagcgcgccgcgggcatcgcccccgccctggcccgtgccgcgcgcgccgccgaagcgggcgtgccggccgtggtcgaggtgatgctcgatccggccgcccgccgcccggccggcgccgtctcgggcaaggcgatcgccgcagccttcggcggcggcgatcccgacgccttcaagtcctgagcctggatggatcccgatcacgagaggcgccgttccccatgtccgtcgacacctttcccccccaccccgccgcaccccgccgcccgcgccttgccgcccgcatcgtcgaggcggcggacggcatcgctctcgaccgcggcggcacgcgcttccatctggaggccgggggcgtggatgccccggcgctgggccgggtgctgcgcctgatcgatggcggtcgcgatgccgaggcgctggagcgcgaggccgggggcgccgacatgccccggctgatccgcgacctcgccgccttcgacctggtcgacgaagcggccccgccggccgcccggtcgggccgggccgccctgttcgcgatcgaggaccggaccaaccgcctgctcttcacccggctctatcgcaaccggttctggcgggcgatgctcgacgatccccatgccgtgcccgagcgcgtcttccatgggatggcgatcgagaactaccacttcctgttccgcgaaagctggttcgacagcccggtcctggcctggaccggcagcacgcccgcgcgggtggcgatgaaccgcttctacggcgaagaggtcggccatgacgagctgatcctgaaggcgctggaggccgtggggctcgaccgcgaaatcctggcccgcaccgtgccgctgcccgagacgatggcgcttgccaatgcgctgtcgcactgggcccggaccgacccgatcctgttcttcgcgacgctcggcgtgctggaaggccgggacatcgacgtcgacagcttcgtgcgcgcggccgagcgccgcggcatggacgaggccttcatcggcccgatccgtgcccatgccggcatcaacatgaacggcggccacggcctgctcacccgcgagatcttcgatgcgctcgacggcatcggcgaggacgagctcggccgggtgatcgacgggctcgacctgttcgtcgagctgtatgacgatttctacggcgcgatcctcgatcactatgccgtgccgggcgaccgggtgcggcgggtggagggcttcgcccccgataccgggctgccggcgatcgcgggcaacgtcaccaccgatccctcggcgcccgaggcggcggtgccgcgccggccgaaactcagggacggtgtcggcgtggcgatcgagcccgcctccatccgcctggattacggcgatcagggctgtgcgatcgacatcctgccggaagggctggacgaggcgcgccggctgatggccgccctcgccgcgggtgccccgcgggcgcagctggcggccgtggcccccggtttcggcgccgcgggtgtgggcgaaatcctgcaggcgctggacgggctgggcctgctggaagacgccgatcccggcatcgcccatggcgtgtcgggcgcccaggcgatgcgcgagctgcgccgcttcgtcgccgccgccgaggcgcggatctgcaccggtgccctgggccgggccttcgccgaaggcagcgcctcacgcgcgcagctgatcggctatgcgatcgaatatcatcaggtggtgcggatgggcccgcgggcggtcgccccggcgctcggccatgccggatcgccggcccgaacccggctgctggaaggcttcctcgccgaagaggtcggccacgaccgcaccctcgccgatgccctggccgcggtcggcatcgacgaggatctgctcgaccggctggtgccgctgcccgagacttttgcgctcacctcgacgctggcggtgctcgccgcccaggatccggtctcgttcgaggccctgctcttcctgttcgagcggccggcgcagcggttccacgatctgctggtcgatcacgcccgggcgctcgacatgcccgaaggcttctggtcgccgctggtctggcatgccgggctgaacgacgaaggtgcgcatggcgacatctcgtcccgcctgatgggcttgcgtgatttcgtcggccgggagcagactctggtgacgctgaaggcggccgtcaccctgctcgaagccttcgaccggctggagcgccgtattctcggccattacgggccgggtgccgacccgatcccggccctgcgcctgccgctttcgatgaccgccacccgcggagagcctgcccgatgaccgcgcccgccgcccccttctcctctgagagcgtccccgtctcccccgcgagcgtccccttctccccctggagcctcggcgcctatcgacggccgcggctggcggtgctgcgaatcgatccccgcagccccgacaccctcgccctggtccatgacggcggcgtgaccgaactcgacgtcaccggcatcggtgcggccgacctcgccgcccggctcgaccggctgcgcgatgcggcggcgggggactgggctgcgatacgcagcgcctcggcggcccgcgcacagcggcgtgcggcgggcgccgacccggatcccgacgggctggtcgatcttctggacgggctcgaccggctggggctgatcgccgaaaccgatgacggccacgatgttctggtcgccgatcacgcccggctggatgcagccctcgaccgcgcagcaggctggatcgccgccgggcggcgcgagatcggcgggctcgaccacaccgccatgctggatcttgcccgcagcctgctcgaccgcatccgcgatctgatcgccggcggcggccaggcgggccccttcgccccgccgccggagctgccgcagggcgccggcttccatgccaccatcctgcggctgctggtcgaagcctgggcggtgaccgcgccgttaagcctggtcgccaccgggcgcctgctcgcccggctgaccggcaccgaggcacggttctcggccccacccggctgtctttatgacatcacggaagccgaatgccatctgggggtggcggcaaccacgctgatcctggcgggcctgcccggggccgaacgccgggcgctgcctcccccggggatcccgatccccgaaaccggcatcggcctgatcctcaccgccgaggcgatgaccccgggcctgctctccgccatcggcgacgaccggatcggggcgctgctggccggccgggatgccggcatcgcaaccgcgatcgcgcgcggcgtctatctggcgcagtaccatgtttcggcacggatcaccgacatcttcctaccggcaatgcgcatggcgctgcgcccgggactgcgcggccgcatgcggcgttatcatgtcgaggaaagcggccatgaagcccatgagctggaggcctgtcgccggctggggctcgatgccgacgcggtgatcgacggtctgccgctgccgcccttcacggcctatgtcgacctgctgggcctgatcgccgatcgtgcacccgccgccttcccggcggtgctgatcgtgaccgaaggcctgcccggccggcccaatccgatgaacggccggctggccgccgccggcatcaccgccgcagaggatgccgaggtccgcgcccatgagcagatcaatatcggcctcgaccacaccaccatgccccgccggctgggtgccgaaatcccgcatctgggccgcgacgatgcccgccgggcgctggatctttatgcgctgatggtggagctgaacgcccgcgcgctgggctggctcgccgccttccatggcgacccggcccgccgccccgtccccgactggctgccggtaccggcacgggatctggccgactgggcccgcgacggcctggtctgacgggggtcaatccggcagcggtcagcgggatgacgatgccggcgctgctcttggaagatccgtctcgccgaagtcattgcccttaaaaagcaaaggctctgccatgtccttcgccagggcataagcaaaacaatcaccataattgagacccgccttgtggcgtccttttccgaaattcagaaatgccagacgagcaagatgcccctgctccacagtcaccggctcgatcacaatgcctgcccggcgaatgaagagatcagcctgctgcattcccgtcgagccaagctgcttatcgatcaccatcgacaactcaagataattggcgacgctcattcgacagatatcggcatcatgtataaaattcacaaaggcctcggcctccgcctctcgataaagaatcgcgaccattgcggaggtatccacaatcatttcggcagcccacgttcatcgtaaagcaaatcgccatgttcaagatatgggcgctttacgtgggctgcagcatgatctgcaatggcaagaagctcctcgacgctcgccttggcggagggctgtcggagccgtgcgtagcgctcgcgcagggcttccgtcaccacgcggctcatgctttggccggtcgcatcggcaatagcctgcgccagacgccgggcttccggatctttgacgttcaggctcatgacatccccctgtttcgcagactggccgccttccggcctcagtttacccctccatagatggggcggataggctgtaaccgccagattctcggggcgcggggccgacaggtcacatgaccagaattgccctgaaatcattcacattcgtccgcgtcgccccggtcacgatccgggtgtccagccgggcgaacagggtgtgggcgtcgttgcgggccagcatctccgccgggtcgaggccgagcgcgcggcagcgggagagcgtatcggggccgatgatggcacccgccaccggctcggcgccgtcgatgccgtcggtatcggcggccagggcgtggatgccgggcgcgccgcccagcgccagggcaagcgccagcaggaattcgacattgcggccgccgcgtccgtcgccgcgcacggtgacggtggtctcaccgcccgagagcaggaccgcgggggcccggaccggctggccatgggcgcgggccgagagcgccatgccggccatgacgcgggcaacctcgcgggcctcgccctcgatccggtcgcccagcaccaggggggtgaggccaaggcgggccgcttctgccgccgcagcttccagcgccagcatcggggttgcgatcatgtgatagcgggcctgatcgaagaccggatcgccgggtttcggggtctcgttggcggggtcggcgagcgcccgggcgacgctgtcagggggcgtgattccccaatccgccagcacccgcccggcatcggcaagcgtggtggggtcgggcacggtcggccccgaggcgatggtcgccggatcgtcgccggccacatcggaaatcgccagcgtcacgacccgtgccggcgccgccgcggccgccagccggccgcccttgatcgccgagagatgccggcggacggtgttcatcgccccgatcggcgcgcccgaagccagcagcgcccgggtcaccgcccgcttgtcgtcgagcggtactcccgccaccggtgccgcggcgagcgccgagccgccgcccgagatcagggccagcagcagatcgtcggggccgaggccgcgcgccagatcgatcaacgccgcactcgcccgccgcccggcctcgtccggcaccggatgggcggcttcgaccacgcggatatgccgcgtctcaagtccatggccatagggcacgatcaccagcccctcgggccgcatcggccagtcggcggtcagctcgtccaccgccgccgccatggtcgccccggccttgcccgcgcccagcaccatcagccgccccctgggcgacgccggcatatgcggggcaagcagcgccgccgaggggcggctggcggccagaccgatgtcgaacaggcgccggagcagggtttcgggggcgagggtcatgggcggcggatccgtctggtcaggggaagaggcggcgcgaagatcgtgaccggaggtcgcacggcttggcaagtcctgcaggacgggccattcttgtggcgcacgcgcacccctccccctccggtggctggccggccacccatcaagggtagggccggccgtcgtccagagatccgattcgtcgagagatccgcatccgatgatcccgtcacgacagcgcctgccccatctgaccgccaccgcgccgctggccgcgatcctgccggtggggtcgttcgaacagcacggcccccatctgccgatgaccaccgacacgctgatcgccggtgccgtcgccgccgcgatccacgacgccctgccggcggacatggccgccgccacgctggtgctgccgccactgccggtcagctgttcccaggaacatgcgggcttccccggcgccgtctgggttggtgcccgcgcgcttgcgggtttcgtggaagatctggcggcgagcctgcgccatcagggcatcggcgtgttcgccatcgtcaacgcccatggcggcaattacgtgctggccaatctggtccaggaactgaacctgaccgcccatccccgcaccctgctgctgcccggccgcgaccattgggcagaggccctgcaggcggccggcatcgcccgcagcctgtcggaagacatgcatgcgggcgaaatcgagacctcgatcctgctcgccgccgcccccgatgccgttgcactgcccctgcccgccgccgatggcgcgcgcgagcggccgcggctgaccgagctgggcatggccgcctatacccgcagcggcgtgatcggcgatccctctgccgccacggcagagaagggccgtgccctgctcgccgccctgggggcgaccggcgcgaccgagatcgtgcgcgccgcggtcatcgtcgcaggcgacgacagctgaggcaggccggatttgaccgtccccttcacgcccgcccccttcacgcccgagttgatccgccccgaggcccacgcccgggtgatcttcctctgcgatcacgccagcaaccacatcccgcccgaatatcaggggctgggcctggatccggccgtgctgggcctgcatgtcgcctgggatatcggggcggcagaggtgacgcgccgcctggccggtgccttcaacgcccctgcggtgctgaccacggtctcgcggctggtgctggacgtgaaccgcttcctggatgatccggcctcgatgcccggccgctccgacggaatcgaggtgccgggcaaccgcggggccgatccggctgagcatcaggcgcgggccgcacggatcttccacccctatcacaccgcggtcgaccgccggatcaccgccctggtcgccgccgggctgcatccggcagtggtctcggtccattcctgcaccgaccggatgggcgggcagcatcgcccctggcatgtgggtgtgctccatgcccgcaacgaccggctggcgatgccgctgctccgccatctgcgcggcgtgcccgagctggtggtgggtgacaaccagccctattcgctgaagacgatgcgcggctacaccaccgacatccatgccgagcgccgcggcctgccctatgtggcgctggagatccgccaggatctgatcgtgaccccggcgggtgctgcggtcatggccggactgatcgccgccgccctttcagcggcgatcgccgggctggactgatcggcctcggcgccccacattccccgtctcccgtgtgatgaggaccagccagatgaccgatacccgcaccgaactcgaagccgccgtcttccgccgcctggtccagcatctgcgcgaccggccggaggtgcagaacatcgatctgatgaacctggccggcttctgccgcaactgcctgtcgaactggtatgccgatgccgcggccgaaaagggcgagccgatcgacaaggaagcggcgcgcgagttggtctatggcatgccctatgccgaatggaaggcccgccaccagaccgaggcgacgcccgaacagcaggcggccttcgccgcgaaacaggcggcggcgcacaaggcctgaggggcacacaagggctgacgccgaccgcggtccggcgtcagaccgcccagcagccgcagccgacggccccccagaagccggccagatcgccgtcctgcaccggcagggaagcggcgcgcggacgggcatgggcatggccgtggatgccgcaggcgccggcacagcagctgccggccgcggcgaccgagcggtcgatgccctcggccgccatcgccgccttgcgctgcttcatctggtccagcgcatagcgcctggtcggcgcccagtcggggctgaccggcagcggcggcggcgccagccggtcgaaggggccggcgccatgcacgatccggccgccgacgatggtcagcaggctttcgatcccggcgatcgcctcgtcggcgaccgtcatcagatcctcggacagcaccgccagatcggcgaactgcccggcctggatccggcccttcttgcctgcttcggtcgagaaccaggccgagccctcggtccacatgcgaagcgcctccagccgcgagggtcgggtcgagggcgggtagagctgcagaccgcccaccgtccgcccgccgatcagccaggcgagcgccgtccagggattgtagctggccacccgggtcgcatcggtgccgccgccgaccggcaggcccatatccagcatccggcgcaccggcggcgtggcctcggcggcgcgggcgccatagcgatcgacgaaggcctcgccctgaaaggccatgcggtgctggaccgcaatgccgccgcccagcgccgcgatccgctccagattgcgcggggtgaccgtctcggcatggtcgaagaaccagtgcagcccgtcgaaggggatctcgcggttcacccgctcgaacacgtcgagcgcgcggccgatgctttcatcataggtggcgtgcaggcggaagggccaacgattggcgaccagcacccgcaccacctgctccagctgaccctccatctcggacggcaactcggggcgcggcatgaagaagtcttcgaaatcggcggccgaaaacaccagcatctcgccggcaccgttgtggcggaaccaatcgccgccatcgcccggcgtcacctgggcggcccagttcacgaaatcctctgtctcggcgcccggacgctgggtgaagaggttgtaggcgatgcgcagcgtcagctggtcgttctcggccagccggcggatgatggcgtagtcgtccggatagttctgaaagccgccgccggcatcgatcacgctggtgacgcccagccggttcagctcacgcatgaactggcgggtggagttgatctgatcctccggctccagcttcggcccgcgggcgagcgtcgcataaaggatcgccgcattgggcttcgccagcaacagaccggtcggctcgccatgggcatcacgctggatctcaccgcccggcggttccggcgtgtcacgggtatagcccaccgcgcggagtgccgcccggttcagcagcgcccggtcgtagagatgcaggatgaagaccggcgtgtcgggggccgccgcattgatctcgtccagcatcggcagccgcttctcgcggaactggtacatggtgaacgagcccaccacccgcacccattgcggggcaggcgtcacccgcgcctgcgccttcagcagggccagcgcgtcgtgaacgctctcgatcccctcccagcgcagctccatgttgtagttcagcccgccgcggatcagatgggtgtggctgtcattgagccccgggatcacccgccggccgcccagatcgatcacccgggtctcggggccggtcgtcaccgccagatcctggcggcggccgacggccagaatgcggccgtcggcgattgcaaccgcatccgcctcagggttggcggggttaagcgtggtgacccggccattgaccagcagcaggtcgggcatcggtgatccgctggatgcagacatgggctgtgatcctccggttgggcgggcatcaggcgggacgggaggggtcggatgcaggatcatcgcgcccctcggtcttcgacgcctgccggggcagatcgccgaagatgtgcggggtgcattcctggcgcatccacgacagggtgatgccctcgccgccgagcgcgcgcttcgcgatcggcaccacctgctcgccgatcagaatacccagaagtccgagcaaagcgatgaccggcggcgcgggcgagcgcacattcagcagaccgtagatcacgccgaccagcaggccggcaccgagggagagaacatagatcttcatggcgctgcggcctccggcccgcaaggtctttggcggtgccgtcaagcgcaccgcaatcagcgccagcttcccgccatcggcctgatgcgtctttcaccggattgctttaattcttagccgcagattgctgtccggcgagggagggcggagatgggcgtccacgccttcgatgaggaacccgcgcatctggcgctctatcgccggctgggtgccacggtcgcgaccagccctgtgggggtggccgagcgctggaatgccccggtcagccgccaggtcgcccgtctgggcgaggcgaccgacttccccggcgtcgatcactacgtgctgaccatccagatcgccggccccgtggtccgccgggtcgaccggccggttaccgacgaagccgggcgcgacggcaccgtgtcattgcaggttcccggcagcggcggacggtttcgcgccgaggcggcggccccggtcgactacgcccatctctatttccgccagtcattgctggacgaggtcgatgacggccatggcggccggcggggtgccggacggctggccgatttcttcggccggccggatggcgagctgccgggccaggtgacgacctatctgacccgcgccttcgacacgaccgatccgcccggcccgatcgagatggattcgcgcgcctatctgatcgccctcgacctgctgcgccgccacagggctgcgccggtcgcggatccggagcgggccggtctgccgggtgggcggcttgcccgggtacacggcctgatcatggaccggctgcacgagccgatccgtctgtcggatctggccagcgccgccggcctcaccccctatcatttcgcccgcagcttccgcggcgagaccggagagaccccgctcgcctatgtcatgcggctgcggctcgaaagggcccgcgaccttctgacccgcacccggctgccgatcgccgagatcgccgccgccaccggcttcgccagccaggcccatctcaccacccgcttccggcgcgccttcggcatcacccccgcccggttccgcgagggctgagccggcctgccaccgcatcgccgcgattgcgccggcccgcgccagccgctatcttgccgcccttgcacgggatccccgcggccgggggttccgatggtcatctgccttgagagacggggatacgatccatgaccgaggtcggcggcatcgcgggcgacgtgctgcgctcgtatatcgagcggatcgagcggctggaggaagagaaggccggcatcgccgcgaacatccgcgagatcttcgccgaagccaagggcaacggcttcgataccaaggtgatgcgccaggtgctcaagctccgcaagatggagccgcacgatgtcgcggagcaggacgaactgctcgaactctacaagcgcgccctgggcatgccgatcggctgagcccccggcgacggaattcgaacgggcgccgcctcttcatcgaggcggcgcccgttttcgttccacaggcggcaggctatgctctcaccccgggggcgacacggtccccggatcagagggagacgacgccatggccctgctcaccatgctcgagatcgacggcatagagccggaacgctccacccccaaccccgccaatgtgctggagggcacgccggtcttccgcacctggagcgtggaagagcggcccgacggcctcgccgccggactctgggaggcaacgcccggcaaatggcgcttcgtcagcgattgctgggaatactgccgcatccgctcggggctttcgatcatcaccgaggatggcggcaccgcccgccgggtcggccccggcgatgccgtcatccttcaggagggctttaccggcacctgggaagtggtggagaccacgctcaaggactatgtggtcaagacctgacccgcgccggtcgcaaacgggtcgcgatcacccgatccagcgccagccgccccggccccgccagggcgatgaccagcccggccaggatccatgggatctgttcggccggctgtgaaatgccgttctccagcccctggggcgtctgacccaccaccagcaggatggtagccgacatcaccgcgaggcccagccccgcgagccggccggcgagccctaccgccagcaataccggcagggtgagttcggccgtggtggtcagcagcgctgcgatccacggatcgacacccggcagcgggtggatgtcgccgaacagaaaggtctgggtcgaccagcgctccaccctgagcatgccggtgtggaaaaacggccaggccagccagagccggagcgccgccagcagaccggccgcgatccagccgtcgccggccccgggcaagcggtaatagccctgcaggatacgtcgcatggggagatccttcgatgatcaggcagcagggccgagcgcgcccgcggatatcagcccgcccagcgccgccggcaggtcgagatcggggcggcgctccagtgccagcgcgaccacggcggcaagcgccggcacctcgccccggtcgttcggacggaataatccggccagaatgccggtcccggcgggcatgaggcggtgaaccggcaggccggacggaccacgcaccaccagcacgcagtccggcccgcgctccaccgcttcggccagatccatggcggcatccggctgatgggccgcccagatcgcctggaccggccagggcgcatcgaccacccgggccgaaggccggagcgccaggcgcgtcggcgaggcctcgccggggtgaaagaccggggtctcgggcgcaaaccagaccgccagccgcgcccattccagccgcgccacccaggagaccgccggccagagatcggcctctgccgccagttggtcggggaaatcggcgccccaggccgacagctgcggtacggccggcgggtgatcacgcagatatgtgcgggcgaagatggcgaatgcggcgtcgccgatcatcatccgggtgaccggaaacgccgcggccagcgcctcgatcgccgcgcccgcggcattgcggcgatgtaccgccagccggcgctgcagggcggcggcggaccagcggggatcggcccagccggcaacggccgccgggtcgaccggcgcccggccaagcgccatcgccgccatccggtcctgaaaatcgccgaggctcatggccgcacccgatcgatggcgagatcggcccgcgccgcctcggcgatcagcaccgtccagggcggcagatcggtgtcgcgttccagcagaaccggcaccggcccggtcgccaccaaagcctgatcgagcagatcccagaccggatccgccaccgcatggccgtgatcgtcgatcagcagcgtcggggccgcagggtcgtcgggatccggctccaccgcatggccggcgatgtggatctcgcccaccgccgcaagcggcatcgccgccagccaggcacgcgcatccccgcccagattatgggcgctgaccgcgatgttgttgacgtcgagcagcaggccgcagccggtctgccggaccagggcggtcaggaaggccggctcgtccatctcaccggccagcggcagataggtggacgggttctcgatcagcagcggccgcttcaacgcatcctgaatgcggcagacattgtctgccagactgcgcaaggcccccgtcgtcatcggcagcggcagcaggtcgtcgatccagccggccggtgtccggcaccaggcggcgtgttccgataccaagaccgggtccagccggcggaccagatcgaccagccgcgccagatgatcggcatcgatgccgccggcactgccgggcgacaggccgacgccatggatcgagaccggcagatccgcccgcagccgttcaagatcccgcagccgcggatgcgacccggcacccgggtgcgcgggcatgaaggtctcggcatggatctccacccagccgggcctggcggcggttcccgacagaaggccggggaggtgcggcgggcgcaggccgatccctgcgatcgcattggtgcctgccatatcaccgcacctcctgccggatggatcatttcgccttgtggaacactcagctcttcttcgggttcatgcccttgaagggttccagcatgccacccatgccgacgcagctgcccttggccaccgccttccagtcggcgccgtcgtaatcggccttggacatgccggcacaggaatgggtgcccgcggcattggcgcagtcgttctggcccgccttcgagatgccatagcacttctcggtctcggcggccgtggccggaacggtggcgagggtcacggcggccagcgacatggcggcggcgatggcggcggtgacgttgtcgatacgcatggtcatcggatcctgctccctctcgatcgggcggcgatgccggtcccccctggaacccgtccgcatccctgccgtccttgagacgagcatagtcaggatacgggcccggccgccaatcaccctccgcatcctcgtcttcacgatttcgtgcgccccgcgtgacgcccgccgggtcgacagcccgggagaattctccgcaagaaaaaacacctttaagttgtgtgaataaatcaagacaccatagaagggcgcagggcgattgcacccttcatacgtgtgtcttctgcggcctgaagatgaatgacgcgtgatgaaatatcgtcgttaagtttcagttcatgattcgatccctccctctccccatgtagcttagagcgagcccgcgtccatggacgcagctccggattgcgaacatcgggcagaacgcgccgatgaccgcccggttgcgcgagaaacgcgcccaccattgtccggatccccggacctgtccctcaggagaagacacatgctcaccaacgacatcgccaccgtccgcaccgccgccgtcgacagcctgcaccgcaccctgtcgggcccccagccctttgcggcggcgcagccccgcagccagggcgggctcgcccccgaactgccgggcctgcagcgccgcatggcggaatggaaggccgagtaccccgagcatcatgtcacggttggccgcgcgccgcaggccggatccatcatgctggccaataacgattatctctcgctcgccgatgacggccggatcatcggcgcgctccgcgccgccctcgacgacgtgaagaccgagaccttcatgtcgggcgtgttcgtgcagttcctcgacgcgcagggcgcctatgagcgcgagatggcccggttcctgggctcggaaggtgttgccctctgccagtcgggctgggccgccaatgacgggctgatccaggcgatcgccgatgccgacaccccggtctatgtcgatctttacggccatgcctcgctctggcagggcatccacagcgccggcgcgaagccgcggcccttccgccacaacaacatgacccatctgcgcagcgtgatcgccaagaacggcccgggcgtgatcctggtcgattcggtctacagcaccagcggcgacctctgcccgctcgaccagctctgcgatctggcggaagagaccggctgcatgctggtggtggatgaaagccatggtgtcggcgtgttcggtccccagggctcgggcctcgtcaccgccatggggctggagcatcgggtgcatttccgcaccttcagcctgtccaaagccatggtcggccgcggcggcatcgtcgccggcacgaagaagacgctggagtatttccgctacacctcgcggccggcgatcttcagctccacggttctgccgcacgagatcgccggcttccgcgccacgctcgacgtgatccgcgccgacgagcaccggcggtcgcggctcttcgccaacaccgcctatctgcgggcgggcctggcggaggtgggcatcgacgtgggctccagcccggcgccgatcatctcgctgatcggcggtgccgaagcgaagacagcacggctgcgcgaccggctggaggatcacggcatcttcggcgcggtgttctgcgcgccggccacgcccaagggccggtcgctggtccggctgacggtcaattccggtctcacccaggccgatctggaccgggtgatccgggcggcggcggattgccgcgacctgctggtcagcgacctgcgcctcgaacgtgatgccgcctgatccgcggatcccgacccggcgggcggcccttcggggccgccccgatccggcagcaggcggcgttcaggccgctgccggtgccgcgatgagcccggcatagagggcggcatcgatattgccgcccgacagcaccacgccgatccgcctgcagccggccagccggccggcggcggcatcggccatggcgccggcgagggcggccgcccccgccccttccgccaggttatgggtgtcggcgtgacaggcccgcaccgcctcggcgagtccggcttcggagacggtcacaaatcgcgacacgccgcgaccgatcacctccagcgcccaggggtcgggcgaccggcaggcgatgccgtcggcaaaggtcgtggcctgttcggtctcgatccgccggccggcggcgaaagacagcgcataggccggcgccccttccgccaccacgcccacgatctcggtcgcaagccccagcgcatcgcgggcgcgcaccgcgccgcatatgcccgaacccatgcccaccgccacatacagccggtccagcgccggcgcggcggtcaggaattccagcgactgagtggcggtgccgtcggcgatgtcgggagagatcgccggcaccatcaccgcccgtccgcccgcggcctcgaccatcgccgcggcatggtcgcgcgccgcctgatagtcggcgccaccctccaccacctcggcgcccagcgcgcgcatggcggcattcttcccggtgctgttgccgcgcggcaccacgatggtcgcggcgatgccgtggcgccgggcggcgaaggcgaccgcctggccgtgattgccgcgggtggcggcgatcagatgccggacctcgggccgcgcccgcagcaggcgggtgacgtggacgatgccgccgcgcagcttgaaggcaccgatcggggtgtggttgtcatgcttcatccaggtctcgaccgccagccgccgggacagcagcggccaggcgatctgtggcgtgggcgccatcgcctcccccacgatccggcgggcatcctccaatgcggcattgatcgtcatcccggcgtctcccctgcacgatcgtcctaaggacaatctttgaattcacttcgtcagctcagatggttgtatcgttccgacgtcatcttcaggacacgccttcaccggccgccggtcaacggcgcgattgtcctgagggcaaatttcacggcaaggggacgtgcaatcatggacgcgctgcacgagggctggcggcaggcggtggaggccgcgcgcggcggcgcggtctatcgcgcactcgccgatgcgatcgccgccgatatcgccgccggccgccttgcccccggggccgccctgccgccgcagcgccgcctggcctgggggctcggcgtcgccatcgccaccgtcacccgtgcctatgacgagctgtcggcccgcgggctggtgacggcagaggtcggccgcggcacccgggtcggccggcggcgccgcgccgatgacggggtgatcgccccgcgggaggccgcacgcccgcggcggcggcgcgagacatccgccgaggccgaggacgagaccgcgctgatcgacctttccctggcccagcccgccgatccggcagcggcggccgccctctcccgcacgcttgccgccctggcggccgccccccaggcggcggagctgctggcctatcagccggcacgcggcgccgctcgccaccgtgcagccggggcagcctggctcggccgggccggctggtcgcccgatccggcgcgggtaacggtcaccgccggcgcccagcatgcgctggtggtggcgctggccgccatcgccgcaccgggagaggcggtggcggtcgaaggcctcgccaacccgtcgatcctggccgcggcccgcttccgcggcatccgcctgaagcccctgccgatcgacgccgagggcgccgaccccgccgcactggaccggctggccgccgaggacggccggctgcgcggcgccattctctccccttctctgcacaacccgaccggcgccagcatgggccccgcccgccgggccgatctcgcccatgtgatcgcgcgtcgcggtctgttcctgatcgaggacgatgttcacgccccccttgcccccccagccgccctgccggcgccggtcgcggcgctctgccccgatcaggtgctgctggtcggcagcccgtccaaggtgctggggccggggctcagggtcggctggctggcggcaccggccgccctcgacgaccgcatcgccgccgctctctgggcctcggcctggatggcgccgccgctcggcgccgaaatcgtcacccgctggatcgacgacggcacggccgaaaccctcgccaccgcggcgcgcgcggccaatctgcgccgccgcaccctgctcgaccagcgcctgcccgggctggacctgacgcttgccccggcctgcgcccatgcctggatcggtcttgggcccgaccggggccatgatcgtgtctgggatccggaccgcttcgccgaagccgccgaagccgccggtgtgcgcgtcgctccggcccgggccttcaccgtgccgccggtccccgtccccgccgccgcccgcctgtcgctggccgccgcccccgacgacgccgtgttcctgaaggcgctggaccgcctggcccggctgctcgacccgcgggcagcgccgtcatcgcttcgcccgatcgcgtaaaacgtctcataaattaaaggttgcaaatatcgtctgttaatcctgttattgattagtcatacttcttgcacagtaccccgccggaagcaaccaccgcccgccgccaccgggccgggcgcccgttccaggaggtatgccccccgtgcccaccgaaacctccgggctgatggccctgctggccttcctgccgatcctcgtcgccggcatcctgctgatcggcctgcgctggccggcggcgcgtgccatgccgatcgtctatctgctcaccgtcgccatcgccctgggcgtctgggggatgagcggcaaccgcgtgctcgcctccacccttcaggggttgatccagaccgccggcctgctctggatcatcttcggcgccatcctgctgctcaacacgctgaagcattcgggcggcatcgccgcgatccgatcgggcttcaccgcgatcagccccgaccgccgggtgcaggtgatcctgatcgcctggctgttcggctcgttcatcgaaggcgcctcgggcttcggcacgccggccgcggtcgcggcccccctgatggtggcggtgggcttcccggccgcggcggccgtcgtcttcggcatgatgatccagtcgaccccggtctcgttcggcgccgtcggcacgccgctgatcgtgggcgtgcaaaccgggctcgaccgggcggcgctgtcggcgacgctcactgcccagggatcgtcctgggacgcgtttttcggcctgatcacctcggaagtggccatcatccatgcgatctgcggcacgctgatgccgctgttcctgatcatggtcatgacccgcttcttcggccgcaaccggtcctggaccgaggggctgtcgatcctgcccttcgcgatcttcgcagccttcgccttcaccctcccctatgttgcggcgggcatgttcctcggcgccgaattcccgtcgctgatgggcgggttgatcgggctcgccatcgtcaccgccgccgcccgcgcgggcttcctggtcccccgcgaccgctgggatttcgccccgccgtcggaatggccggccggctggatggggcgggtggaaatccggctcgatcagctgacggcccgccgcattccggtggcgctggcctgggcgccctatgtgctgctcgccgtgatcctggtggtcagccgcacggtgccggctgtcggcgacgcgctcagatccgtcaccttccgggccaccaacatcctgggtgagaccggcatcggcggcgatttcgccctgctctatctgccgggcggcattctggtcatcgtctgcctggtcacgctgctgctccaccgcatgaagccggccgccttcggccgggcggtcggcgaaagcgccggcacgctggtcggcgccggtttcgtgctgatcttcaccgtgccgatggtgcgggtgatgatcaattccggcgtcaatgccgaagggctcgccagcatgccggtgatgatggcccgcgccgtggcagacggcgtcggtcatgtctaccccctcttcgcccccacggtcggcgcgctcggcgccttcctggcgggatcgaacaccgtctccaatctgatgctcagccagttccagttcagcgtcgccgaactgctgggcctctcgggcgcgctcatggtggccggccagtcggtaggggccgccgccggcaacatgatcgccatccacaatgtcgtcgccgcctcggcgaccgtcggcctgctcggccgcgagggctcgacgctccgcatcaccatcctgccgacgatctattacgtgctgctcgccggaaccctgctgctgatcgggttccacgtgctcggcctcggtgatccgctcaccccggcctgatcaccatgtggcgggggcgttgcgcccccgccacatggcttgacgtcttctatattttgaatattctagaattatgaaaaaaacagaggtcatcaccgccctggcggcgctcgcccacgaggcgcggctcgacacgttccgcctgctggtccaggcggggccaggggggttgcccgcgggccagatcgcccaggcgatcggtcttgccgcccccaccgcctcgtttcatctggcccagctgaaacaggcggggctggtcacctgccggcgggaaagccgctcgctgatctattctgccgccttcgaccggatgaccggactgatcggcttcctgaccgaaaactgctgcggcggcaacccggccgcctgcggcctgccgcacccgggggctgggacgcccccatatgcctgaggcactgcatgcctgaaaccggccgcctctcctttctcgaccgctggctcaccctctggatcttcgcggccatggccgcaggcatcgccctcggccatctgctgcccggcctgccggctgcgctcgaccggctgaccgtcggcaccaccaatctgccgatcgcgatcgggctgatcctgatgatgtacccgccgctcgcgcgggtgcgttacgaagacctgcccaaggtctttgccgaccggccggtcctgctgctgtcgctggtccagaactggctgatcggcccggtgctgatgttcacgctggccgtgatcttcctgcacgatcagccgggctacatgaccggggtgatcctgatcggccttgcccgctgcatcgccatggtcctggtctggaaccggctggccggcggcgacggccagtatgttgccgggctggtcgccttcaacgccatcttccagctgctgttcttcggcctctatgcctggctgttcctgaccgtgctgccgccgctcctcgggctcgacggggtggtgatcgaggtcggcttcacgacggtcgccgaagccgtcacgatctatctgggcattccgttcctggccggcttcctcacccgacggatcctgatcgcgacccgcggccccgactggtacgagagccgcttcctgccccggatcgggcccgtgacgctggccgccctgctcttcaccatcatcgccatgttcgcgctgaaaggcggcgacgtggtccggctgccgctcgatgcgctgcgcatcgccctgccgctggtgatctatttcgtggtgatgttcgcggtctctttcgtcatgggccgccggatcggggccgaccatccgcgcaccaccgccatcgccttcaccgccgccggcaacaatttcgagctggcgatcgcggttgcgatcgccgccttcggcctcgcctcccctgctgccttcgcagccgtgatcgggccgctggtcgaagtgccggtgctgatcctgctggtccaggccgcccgccgcgccgcgcgcttctggaccaccccaaccccaggacccgcccgccgatgaccacgatcacccgcctgcggccgctcccggacccgcatcatctgccggcgctcgatccgcactatgtgatccccgaccccgccgccgggctggcgccgggcgggcccgatcacaagcccaggatcctgctgctctacggctcgctacgcgaccgctccttctcgcgcctggccgtcgaagaggcggcccggctgctggaggccttcggggccgagacccggatcttcgatccgcacgacctgcccctgcccgaccaggtgccgggggatgaccaccccgccgtgcatgacctccgcgccctgtcgctctggtccgaggggcaggtctggtgcagcccggaacgccatggccagatcaccggcatcatgaaggcgcagatcgatcatcttcccctgcagatgaagggcctgcgccccacccaggggcggacgctcgcggtgatgcaggtctcgggcggctcgcagagcttcaatgcggtcaacacgctgcgtctgctcggccgctggatgcggatgttcaccatccccaatcagtcgagcgtcgcgaaagcctggcaggaattcgacgaggtcggccgcatgcgaccgtctgcgtattacgaccggatcgtcgacgtgatggaggaactggtccgcttcaccatcctgctccgccctcatgcgggccagctggtcgatcgctattccgaacggcgcgaggccgggcagcaggccggcgccacggccgaactggtggcgaagtcgatcgggaccggccgttgatcgcggcacacgcgcaccagggctgacgccttcggcccaagctggcatgatggcgggcctgcactctctccgccgacggcggttgccgccgacggccatgaaagccggacccgccatgctcgcccgcctccgccgatccgccgccgccgggattgcggcggccctgctcgcctcggttctgaccggtcccgcgctggcccagaccacggccggcccgtcgatgaccgatggtcgtgcagcgccggaagcggcgaccggccgcgccgcaagccgtggcccggtcgccacccggcagatgatggtggtcgccgcccatccgctcgcggtcgatgccgggcgggcggtgctggaagacggcggcagcgccgccgatgccgcaatcaccgtgcagctgatgctgggcctgctggaaccacagtcgagcggcctcggcggcggtgccttcgtgctctaccatgccgccgccgcgggccggctgaccacgctggatgcgcgcgagaccgcccccaccgcggcgggccccgaccttttcctcacccccgacggcagcccgatgggcttccgcgacgccgtgcccggcggccggtcggtgggggtgccgggggtgccggcattgatcttcgcgctgcatgagcgctggggccggctgccgctggagcggctgttccagcctgcgatcgcgctcgcagaggccggggtgccggtctcgccgcgcctggcggggcttctcgccgacccccgcgcctcggcctcgctccgcaaggatccgcgggccatggcgcatttcatgccggggggccagccgcccgctccgggcacgctgctacccaaccccgattatgccgacacgctccgcgccctgctgaaggatggcgtcgccgccttctatgccgggccgatcggcgccgatctggtcgcggccgccgccgcgcgcgccgacaatcccggccggatcgccgaggccgatcttgccgcctatcgggtggtggagcggcccccggtctgcgtgccctatcatgcccatgacgtctgcggcatgggcccgccctcgtcgggcgggctcgcgatcggccagatcatggggcttctggaccgccatcccctcgatccgaaacagagcccgctggcgctgaccaacatccatctgctggcggaggcatcaaagctcgccttcgccgatcgcgaccgctgggtggccgatcccgaccatgtgccggtgcccgtggccgggctcgtcaacccggtctatctcgacacccgggcgcgcaccatcgagccgggcaaagccctgccggtgccggccccggccggcctgccgccgggggcccagaccctggcgctggcagccgatcccggccggcacgagaacggcacctcgcatctgtcgatcgtcgatgccgcgggcgatgtcgtctccatgaccaccagcgtcgagggcgccttcggctcgggcgtgttcgtgcgcggcttcctgctcaacaaccagctgaccgatttctccttccggcccgagatcgacggccggccggtgatcaaccgggtggagccgggcaagcggccacgcagttccatggcgcccaccatcgtctacggccccgacgacctgccggcgatcgtcgccggctctcccggcggcagccggatcatcggctatgtcgcccaggccctgaccgcgatgatcgatttcgacatggacccgcaggcggcggcggagctgccccatgtgctgaaccgcaacggcccgaccgagatcgaagccggcaccggggccgaagccctgatcaccggcttcggccttctgggcgatcagaccgcgaccgccgagatgacgagcgggctgaacctgatccggatccgccccgacggcacgctgcagggcggctccgatcccaggcgtgaaggcattgccgcgggccggtgagccgcgagccggtgacaggaaggaagatcacgggcatggacatgaagcgcatccgggccgggcagctggagatcgcgtatctggaggccggcgcggcgagcggcccgccggtggtgctgctgcacggttttccctacgacgtccacgccatgaccgaggcggggcggatgctcgccgcctccggccatcgggtgctgatcccctggctgcgcggctatggtccgacccgcttcctggacgacgcgacgccgcgttcgggcgaacaggcggcgctgggggccgatctgctggccttcctggaggcgctcgacctgccgcccgccgtgctcgccggctatgactggggcgggcgcgccgcctgcatcgtggcggccctccggcccgaacgggtgcgcgggctggtgagcggcggatcgggctacaacatccagaacatcgccgccgcatctgcaccggcaacgcccgaggccgagcatcgctggtggtatcagtattatttccacggcgagcgcggccgggccggtctcacccggaaccgccgcgatctctgccggctgctgtggaaactctggtcgccggactgggatttcgacgacgcgacctttgcccgaaccgccgccgccttcgacaaccccgatttcgtcgaggtcgtcctccattcctatcgccaccgctatgcgctggtggcgggcgacccggcccatgcggcgatcgagcagcggcttgcggcccagccgccgatcacagtgcccgcgatcgtgctccagggcggcagcgacggggtcgatccgcccgaaggccgcgatggcgaccgccggcagtttcagggtccctggtcttacgaggtgctgccgggcatcggccacaacattccccaggaagcacccgcggcctttgcccgcgcggtggcagagcttgcccgccgctgatgccgtccctgcctctgcccttcgtcggcgcgctgctgctcgccattctctgcgcgcggctggtcgcaggcagcgagcccggccggcggatcacgccgccgctggtgttcgttgccgcctgcacgctggatcttatcgtggtcgggctgcgctggagcaccgatctcgcggccatccgcgcccttcagccggtggtcgccgccaccctgccgccgctcgcctggctgtgcttcgcccgcctcacccggccgcgacgccgtgccctctggccacatctgctgccagtggccctggtggcggtgctgtcgggcatctggacgctgtggaaggcgccgatcgatggggtgctggcggccgtcttccttggttatgccgcagccctgctgcgcctcgccgcccgcggccccgatgcgctggcggcggcgcggctggacgacgccccaaaggccatccggtcgatacgtctggtcgggctggtactggcgagcttcgccctggtcgacctcgccatcgccgtcgatgttgcgctctcggccggtcgccatgctgcgctgatcgtggccgcggccaatctgatcgccctgcccgccggcgcctgggccatcgccaccaccggccttgccccgccgcagcagccggcggtgccaacggaaccgccacaagcgaagacggcacaggatgacgagcctccggctgacgaggacgacctcgccgaggatcaggcgatcatcgaccgcctcgacgccctgatgcaggaccgcgcgccctatcgcgaccccgacctcaccctcgaccgcctcgcccgccgtctgggcctgccggcccgtcgcctctcggccgcggtcaaccgccgcctgaaccgcaatgtctcgcaactggtcaacgaccaccgcgtggccgaggcctgccgcctgctctccaccacggacgccccggtcacccggatcatgttcgacgcgggcttccagacaaaatccaacttcaaccgcgaattccgccgggtcaccggcaccacccccagcgcctggcggcgggatcggcggggggcgggggcgcgcacgccgtgatcgtcaccatgtctgccgaaagagaggcaccgatgtccatcaccctcttcctcgacctgcttgccgccgacatcgacgcgcatccggagcgcctgatcccgctcgatcccgcccttatacagcatgccctggcgctgactgccggggtcgagatcgatctcgacgccccgctgtcggatgaagatgagtaggggcggtgcactcgccgtcctgacgatccacacaccccaaacgggttcaaaccgaagatccgcgccccgcttgcgcccccgtcagcggcgggccaggatgaccgtgccggcggtgccgaacatgccgcccacgccctggacgaccgaaatgcgggcgtccctgacctgtgccccttcgggcgccgtgccgcgcatctggcggacggcttcctgaagcgcgtacatgccgtacatgccggaatgcatatagttgatgccgccgccattggtgttcatcggcagccggccgccgggggcggtgtggccgtcggcgatgaagccggccgcctcgcccggtttcacgaaacccagcgcctccagcccatagagcggcacatgggcgaaggcgtcgtagatcatcagatggtcgacatcggcgcggtcgatgcccgccgtggcgaaggcctggtccccggccacgcggaaggcgcgggagctggtgtagtccttcatctcggtgatcatcagatgttcgacgctctcgcccgtgccgatcacgtcgaccgggcgggtcgggaaatcggccgcgcggtcgggagcggtcagcaccagcgcaccgccgccatcggtgaccagacagcacatcaggatgcggaacggccaggcgatcatgcgcgaggccagcacctcgtcgatcgtcaccgggtcgcggcggaaggcgcgcgggtggaaaccggcccattgccgctgcaccaccgtcacccgggcgagatcttcctcggtcaccccgaaggtcttcatgtagcgcagcgccgggatggtgaacagcgtcgccgccatggtcggggtatagcccagttcgaactggcccatcagcgaatgcgcgggcaccgtccagggcacatggccgacccgcgaccggccgctttcgccatgggtgatcagcaccgtgcggcagagcccggcccggatcgccgccgcggcatgggcgacatgggtcatgaaggaacagccgccaatattggtggcatccacccatgtgggcgtgatgcccagatactgggccagcatcgcggggttttcacccgccgtggcgatgccgtcgatatcgccaggggtgaggccgcaatcggccagcgcattcagcgccgcatcggcatgcagatccagttccgacatgtcgggcagcacgccgagccgggtggtttcggccgcccccacgatcgaggccagggggtgggtcaggctcatgcaccggctccgttgctcgtggccaccggcctgaatttgggcagggtgatcgtctcggagaccggctcgaacaccacctccagcgccatgtcgagcggcagcgcctcgggtgtctgggggcaatccacgatattggtcatcatcagcggcccttcgtccagccgcaccaccgccactgcataggggccgtcgccgcccttgggcaccatgtggttgatcacatagctccagagcgtcgcccggccgctgcatttcagcgccgtcacctcccgcccgccgcaggcggggcagaagggccggggcggaaaatggcggccgccgcaggcggtgcattcctgaacgtaaagctcacctctccgggtcgcgtcccagaaccaggccgtcgacggcgtcggttcgggcaggctgcctctcagcatcggttaccctcgtctgtggtgtgtcatgccccagggctcatgccccaggacccgtcttcgacgacggccggggcagaaaggagtttgacaagcgggggccagatgatcaaatctttgatcaaagatcgagcatcaatcgctcaccacctcctttcccccgcatgcctgcccggcaggtcgccttccccggcggcatctcaccgggcgtcttccccgcctggcgggcgcggccttccattgccgtcgattgaatacgatggcatgtgatcaaccgcggccggacgggcatgcccctgatgtcattcccccgaggacgaggaccctcccccatggcagacgtgcccgagaccgcggccgatgcggccgcaaagccccgcagccgcggcaagaagctgatcatcagctgtgcggtgaccggcgccgtgcacacgccgaccatgtcgccgcatctgccctatacgcccaacgacatcgccacccaggcggtggatgccgcgaaggccggcgccgcgatcctgcatctgcatgcgcgcgatcccgaagacggccggccgagcccgaagcttgcccattacgagggcttcgtgccccgcatccgccagcaatgcgatgcggtgatcaacatcaccaccggcggctccaccgccatgaccatggaacagcggctggaaggcccgctcggcctctcgcccgagatctgctcgctcaacatgggctcgatgaacttcgtctattccgatctggggcagcgctatcagaactggcgcttcccctgggaaaagccctatgtcgaggcgacgaaggacgtcatcttccgcaacaccttcggcgatatcgaaaccatcctgcgcgagatgggcgaacgccggggggcgcgcttcgaatacgagtgctacgacgtcggccatctctatacgctggcgcatttcctggaccgcaagctcgcgaccccgccgctcttcgtgcagatggtcttcggcatcctgggcggcatcggcgccgaccccgacaatctgatgcacatgaagaccatcgccgaccggctgttcggcgacgccttcgaatggtcggtgctggctgccggccgccatcagatcaatttcgcgaccatggcggctgccatgggcggccatgtccgcgtcgggcttgaggacagcctctatgccggcccgggcaagatggccgaaagcaatgccgagcaggtcgccaagatccgccggatcgtcgaggaactcggccgcccgatcgcgagccccgaagaagcgcgtgccatgctgggcgtgccgtcgagggccgccgcggcctgattgccgacacgccgaccttccgcaccatccccctcccgtccggtgcccttgcggggagcgcaagagcaccggacggcgagcggcagaccacccgtctgaagcccccgatacgacccagaccgagacggacagacaagaaccgcacgggaccatcgacaggaggcaggaatgctgcacacacggccgagggggcgcctgcgcgcccgcctcattgccgccgccgcctcggcggcgttgaccctgacggccattgccggcgccgcccaggcccagagccgggaagagacgttgcgcgtggtgaccggcggccaggtgaataccctggacgccggcatgcagggcatcacccgcgacggcttcggcctgaactggaacatctacgaccggctggtcagctgggaccggaagaaattcggcgacggctatatctacgacttcgaccatatgaagggggagctggccgagagcttcacgatcagcgatgacggcctgaccgtcaccttcaagctgcgccccgacgccaccttccatgacggttcgccggtcacggccgaggatgtgaagtggtcgctggaccgcgcggtgtcgctgaagggcccgggtgcgcagatggcgaccggctcgctgaaatcgcccgaccagttcaagatcatcgacgcccacaccattcaggtgacgctggacaagccggaccggctggcggtgccgaacctggccgtggtcttcccggtcatcctgaattcgaagctcgccaaggaacacgccaccgccgaggatccctgggcgaccgagtggctgaaggaaaaccaggcctcgggcggcgcctacaaggtctcgaccttcaaggccggtcagcaggtggtgctggagcggttcgacgactggaagagcggcccgctgccctatttcaagcggatcatcgtccagaccgtgcccgaggcatcgacccgcgccagcctgatcgagcgcggtgacgccgatctctcgatcgatctgcaggcaagcgacgtgctggcgctgaaggatcgcggcgccgtcaaggtggtgtcgatcccgcaggtcaacgccttccagatgatcgccttcaacacccggatggcgccgttcgacaacgtcaaggtccgccaggcggttgcccatgcgctgcccttcgacgacatgttcaccgccgccctctaccgccgcggtgcgccgctctggggagcgacctggaaggatctgcccgacaacggcaagttcccgcagcgtctgccctattccaccaacctcgacaaggccaagtcgctgctggccgaagccggcttcccgaacggcttcaagaccaccttctcgttcaatgtcggctcggccgcgaccagcgagccgatcgcggcgctgatcaaggaatctctcggcaagatcggcatcgacgtcacggtcgagaaggtgccggatgcgcagatgggcaccctgatctcggaaaagaagctgcccttcttcaccgaaagcgccatcgcctggctgccctcggccgactatttcttccgggtgttcttccagggtgagacccggtggaactacggctcgttcgtgaacgaggaactggccgagctgaccgccaaggcacgctacgagcgtgaccccgcggcctatgaagcggccgcgaagcgcatggtcaagatcgccgccgacgaggtgccggtcgtgatgctctggcagcccgcgctcgatgcggtgatggcgaagaacatcgacggcttcacctactggttccaccgtcagaccgactatcgcagcctgacccggaccaagtgacgccgccccgccccgtggcccgggccatagcccgggccacggggcagccacccgcctcagggaaaggacgacccccatgcgctcgatcgcataccggtccgcccgacggttggccgccgccctgccggtgctgctgggcgtgctggtcttcaccttcgtgctgatgcggcttctgcccggcgacccggccgtcttcttcgcctctggtccgaattccggcgaggccgaaatccaggcgatgcgcgagaagctgggcctcgaccgctcgctgcccgaacagttgatcctctatctgggcgatgtcgcgaccggcgatctcggcacctcgatgaccaccggccggccggtgctggacgatctggccgaacgcctgcccgcctcgctcgaactcaccgtggtcgcccttgtgctggcgctcgcgaccgccttgccgctcggcatcctggcggcgctgatgcccggctcggtgctcgaccatgtggtccgcgtggtctgcaccgccggtgtggcgatgccgacattcgtctcgggcctgctgctgatcttcgtcttctactacctgctgggctgggcgcccgatcccaccggccggatcgacgtcttcctgatcgcgccgccgccggtgaccggtttcctgctgatcgacgcgctgctcgccggcgatatggaggtcttccgggccgccctcggccagctgatgctgccggcgatcaccatggccctgttcgtgctggcccccttggcccgcatgacccgcgcctcgatgctggcggcgctgggcggggatttcgtccgcaccgcccgctcgctcggcctgccgggctggaaggtggtcaatgtctatgcgctccgcaacgccatcctgccggtgctgaccaccaccggcatcatgttctccaccatgctcggcgccaatgtgctggtggagaaggtcttctcctggccgggtgtcggctcctacacgctggatgcgctgctcgcctcggattatgccccggtgcagggcttcgtcctgctgatggccggcatcttcgtggtggtcaatctgatggtcgatctcgcctacgggatcgccgatccgcgggtggtgatcgaatgagcacggcaacgctgaaacatgtgggctgggtgctgcgcggcaatgccgtcaccgccggcgccgcgctggtcaccctgctgctggtggtgatcgcgatcctgggcccggcgatcgcgccgcatgatccgctcacctccaacgtcgccaatgccctgacgccaccctcggcggagcactggttcggcaccgaccgcctcggccgcgacatcttcagccgggtgctggtggcgacccggctcgatctgggcatcgcggtcgcagccgtgatcctgtccttcgccatcggcaccgccatcggcggggcggccggctatctgggcggccgcttcgacaagatcaccggccgggcagtcgatgtggtcatggccttcccgcttttcgtgctggccatggcgctggtcgcggccctcggcaaccgggtcgagaacgtggtctatgcgaccgcgatcatcaacctgcccttctacatccgtttcgcccgcgccgaggtgaatgtccgccgcgatctgggctgggtggaggccgcgcgcgcctcgggcaacggcaaggcggcggtgctgttccgcttcctgctgcccaatgtgatgccggcgatgatggtgcagatctcgctcaatctgggctggtcgatcctgaatgccgccggcctctccttcatcggcctgggcgtgcagccgccgactcccgaatgggggatcatggtcgccgaaggcgcccgcttcatcaccaccggctattggtggaccgtggccttccccggcctcgccctggtcgcgaccgtgctgtgcttcaacctgctcggcgatggcctgcgcgacatgctcgaccccaggatgcggacatgatggtggatcacgcaacgatgacccggagccttgcccgcaacaccggcgccgatgccgcagaacccctgctctcgatccaggatctgaaggtcggcttctccacccgccgcggccgggtggaggcgatccgcggcatctccttcgatatcgcccccggccaggcgctgggcgtggtgggcgaaagcggatcaggcaaatcggtcacggcctatgcgatcaccggcctgctcgaccgggcgggccggatcgacggcggccgcatcctctatcgcggccgcgatctggtcggcgcctcgcgatcgaccatgaagcggctgcgcggcggtgcgatctcgatgatcttccagaacccgcgcgcggcgctgaacccgatccgcaaggtcggcgaccagctggccgatgtgctgatggcccatgaggggctgaccggccggcgggcgcgggccaaggcggtggaactgctcgatcaggtgcgcatcaacgatccggcgaagcggctggatgcctatccgcacgagttgtcgggcggcatgtgccagcgcgtgatgatcgcgctggcccttgcctgccacccggatctgctgatcgccgacgagccgaccaccgggctcgatgtcaccacccagaagaccgtgatggatctggtggcgacgctgacccgcgagcgcggcatgtcgatgatgctgatcacccatgatctgggcctggccgccgcctattgcgaccggatcgcggtgatggaacgcggccttctggtcgaggcggcaccctctgccgatctcttcgcccgaccgcagcacccctatacccgccgtctggtcgccgcgacgccacggcgtgagtccacactcgacgatctggtggcggccgcccccgaagccgcggccctcgccgcccggccggccgaagcggcgcaccgggcaccggcaaccgccagcccggcgacaccgcttctggaattgcgcggcctgatcaagcggttcggcgacgtgaacgccgtcgacgacgtcgccttccgcctgaatgccggtcaggcgctggggctggtgggcgagagcggatcgggcaagaccaccatctcgcgcatggtctgccggttggtcgatgccaccgcgggcgagatcctgttcgatggcgaggatatctctcaggtgccggccgcggtgttccaccgccaccggctgcggcgcgacatccagatcgtgtttcaggacccgaccgagagcctgaacccgcgcttcaccgccttcgacagcatcgtcgacccgctgcgccggctgggcggcccgcagggcgcccgcagcctgagggcgcgggcggaggatctggccgaccgggtcggcctgccccgcgagctgctcgaccgcttcccccatcagctgtcgggcggccagaaggcgcgggtcggcatcgcgcgcgcgatcgcggtggagccgcgcctgctgatcctggacgagccgaccgccgcactcgacgtgtcggttcaggcggtggtattgggtttgctggatcgccttcgacgcgagaccggcctgacctatctctttgtcagccacgatctgaatgtggtgcggatgctgtgtgagacggtggtcgtactccggcgtggccaggtggtggaagcgggcgaaagtgccgccgtcttcgaccgcccggcccacccgtatacggccgagctgatcgcggcgattccgcatttcgaacccgacgcggcctgaggtcgccggcggcccgcgacgggccgaccgatcagaagacgttgacgaccagggccaaggagacgcacgtgacgcaaaatctgctggatctggcgggcatcgaccggcccatgaagacgaccctgcgcgaccagatctacacgcggctgcgcgaggcgatcatggccgggcggttcctgccaggccagcatctgggtatcatcgcactcgccgaggcgctgaatgtcagcgcgatgccggtgcgcgaggcgctgcgccagcttgtggccgaaggcgcgctggaaatgctgcccaaccgcatggtcaaggtgccggtcatgacccatgagcggttccggcagatcctgggcatccgtctgctgctggaaggccatgcgaccgagctggccacaccccatttcaccgatgcccagtgcgaccggctgcaggagctgtccgacggcatggcggcggcgctggcggagaacgacgccgagacctacttcgcgctcaaccaggattttcacttcaccatctacaaggcctcgaactcggacgtgctgatgcagcacatccgcatgctgtggctgaagatggggccgttcatccggctgagctacaaccagagcggcgtgaaggcgaccgaggtcaatcatggcgaggcaatcgcggcgctccgcgcccacgatccggtcgccgcggccaacgccatccgcatggacctgatggaggccgccgaggtcatccaggaggtcaatcccgcagccttcaccgatgtcgagccgaccgcagaattgcacgtcctcgacgaggagtagttggtttgtccgccctcgccgggcgggtgctccgcacccttggccgccgccgcaatggcggctggagtttgtacgccctcgccgggcgggtgctccgcacccttggccgcccccgcaatggcggctggagtttgtatgccctcgccgggcgggtgctgaagcaccgtccggctcccggtcgcccctgacggggtgccggctccccctccggccggcgccgcttgacaggcgtcggcatgcgcgtaaagtttgatcaaagatcgaagatacgaggtggcctgatgtccggacgcccccatcgctgggtcaaccagcatgccccgacccagatcctgcccaaggcgctgaaaggcgagggcgtgtatctctacgatgccgccggccgtcgctatatcgatggctcgggcgggccggcgctgttctgcctgggccattcgcatcccgaggttctggcagcgatgcgcggccagctggaggcgctggaattcggctacaccacaaccttcaccaccgatgcgatcgatgcgctgtcggagctgctggtggaacaggcgggcggcaacctgacccgcgtctcctatgtctccggcgggtcggaagccaacgagaccgcgatgaagctggcgttgcaggttcagcgcgcccgcggcttcgccaaccgcacccgtttcgtggcccgcaaccagtcctggcacggctacaccatcggcacgctgtcgctgtcgggccatcccgcccgccgcgcgccttacgaaaaggcgctgctcgacgtgatccacgtctctgccgccaacgactaccggccaatcgccaccacggggcgcggcccggaagcgctggccgaggcgctggccgccgaattcgagcaggcgctgctcgccgccgggcccgagaccgtcgccgccttcttcttcgagccggtggtgggggccgccggtggcgccgtgcccgcacctgccggctatgcacggcggatgcgcgaggtctgcgcccgctatggcgtgctgatggtctcggacgaggtgatgtgcggcgtcggccgctgcgaggcctggcgggcgctggcggtggacggggtcgaacccgacatcatgaccatcgccaaggggctgggcggcggctacatgccgatcggtgctgcgatctattccgaacaggtctatcaggacatcatcgccgccgacggccgtgtcgccagcgttcatacctattccggccacacgctcgcctgcgccgcctcgctcgccgtgcagaccgtgatccgccgtgacgatctggtcgagaagtgccgcgtcgacggcctggcgcttcacgacatgctgacggcgagcttcggccagaaccccttcgtcggcgacatccgcggccgcggtttcttccgcgccatcgagctggtcgccgatcgcgagagcaaaacccccttcgcccccgaactgggccttgccgcccgggtggccgaaaccgctttcgagaacggcctgatctgctacccctcgcccggcaccgccgacggcatccgtggcgatcacgtgctgctggcgccgcccttcaccgccagccgcgaggaactggccgagatcgtggacaagcttgcccggaccctcgacaccgtcctcgcccaggcccgcgccgcatgacttcgggaacgatcatgaccaactctgcgaacccgcgccgctggcgggtcggcatcgatatcggcggcactttcaccgatgtcgtcgccatcgacaccgccagcggcgagcgccgcctggccaaggtcccgaccgtcccctccgccccgttgagcggcctggtcgcggcgctggacgccgttggcctcggctggcccgacgtctcggaactggtccacggcacgaccatggtcaccaacgccctggtcgagggcaagaccgcgcctgtggcactcgtcaccacccgcggcttcgaggacgtgctggcgatcgcccggcagagccggcagaccctctacgacctcgccaccccgccgcggctggcgcccgacgtgccccaggattgctgcttcggcttccacgagcgggtcgatgcccagggccgggtggtgatcgagcccaccgatgccgagatcgagcgcctggtcgccaaagtccgggccagcggcgccggcgccgtggcggtggccctgctccatgcctatgccgagcccgcccacgaggcgaggctgggcgctaagctgcgcgaggccatgccccatgtctcgctgtcgcacgaggtcagccccgaggcgcgcgaatatgaacgcacgctgaccacggtgctgaatgcgggcgtcatgccgctcgcctccacctatgtcgagcgtctggcgggccatgtgccggcgggcacccatgtccatctcttccactctgcgggcggcatgacctctcttgccgccgcgcgggcacggccgctctcgctcgcgatgtcgggtcccgcagcgggggcggccgctgccgccggcgccgcagccgaggccggtatcggccacgccctcgccttcgacatgggcgggaccaccaccgacgtttcgctgatcgtcgacggcgtggtcgaaatcgccagcaaccgccggctcgccggccggccggtgcgtcagcccatggtcgcgatcgaatcgatcggcgccggtggcggctcgatcgtgcgcgccgcccatggcgggctgaccatcggccccgacagcgccggcgccgatccgggccctgcggtctatgcccgtggcggtgcccggcccacgatcaccgatgccaacgctatcctgggctatctggatcccgaacgggttctgggcggctccatccggctcgatctcgacgcggcggcgaaggtgctggcgccgatcggcgaggcgctgggccgagacacccagggcacggcgctcggcgtggtccaggtcgccaatgcggtcatggcccgtgcgctccgccgggtgacggtcgaacgcggtgtcgacatccgcggctgcacgctgatcgccttcggtggcgccggcccgatgcatgcctgcggtctcgcccgcgaggtcggcatcgaccatattctggtcccgggtgtctcgggcggtttctccgcctatggctgcatctcggccgagccctccttcacgcttcagcgcaccgtgcgcctgaagcgcagcgactggtcagaagaccgtttcgatgcggccctcgccgaactccgggcccaggcggccgagccgctgatcgaggccggtttcgatgccgggctgatctccaccgccgaaaccgccctgctgcgctatgtcggccaatccgatgcggtcgaggtgccggtcgccggcatgcgggcggcagaggacatcacccgcgccttccacgatgcgcatgtccggctctacggctatgccaccgacgagccctgggaggtcgaatcgatccgcatccgcgcctcggtgcctgcaaccgacatcgccgccgccccggtgacgaccgccgaggccggggccgcgctgccggtcaattcccgcaacacctgctggttcgacggcaccggcccggtcgacacgccgcgcatcgaccgcgaccgcctgcccgtcgatctgaaggtccaaggcccggcgatcatcgaggatgcggtctcgaccgtggtggtcgaacccggcgccaccgcctggaccgaccggttcggccatctgcacatccgccttgcgaccgggagctgagcccatgagcaccgatctccccaccaccgtcgatcccttcgtcgtcgagatcatccgcaacgccctcacctcggccgccgaggagatgtcgctggtggtgatgcgctcggcccggtcgccgctgctgcgcgaggcgggggacctgtcctcggccctgaccgaccacgaaggcgggctgatcgcccagggccatgacgtgccggtgcatctgggcgtgatggccttcaccatccgtgccttcctggacagggtgccggcggagcgtctggccccgggtgacgtctggatcctcaacctgcccgatgtcggcggcaaccacctgcccgacgtgaaggtgatccgcccggtcttcgccggcgaccggctgctggccttctcggtccagcttgcccactgggccgatatcggcggggcggcgcccggcagctattacgccgccgccaccgatgcctggatggaaggcatgcggatcccgccgacccggatcttcgccggcgaccggccggaccacgagaagatcggcctgatcctggccaatgtccgcggcgccgccgaacgcgagggcgacctcctggcccaggtggcggcaacccgcgtcgccgagcgccggatcctggaaatcgtcgaacgccacggcgccgacacggtcgccgccgccatggccgcccttcaggacatctcggaagcgcagatgcgggcggcgatcgaggccctgcccgacggcgtctatgaaggcgtcgactatctggatgatggcgggccgggcgaccggccggtggcgatccgggtgcgggtcgagatttcgggcgatcgggcccgcttcgactggtcgggcaccgatgatgcgatcgcaggcccgctcaacaccacgccctcgatcgcgggcgccgcggtcttctacgtggtgaaatcgctggcgggtgcggccatccagcccaatggcggctgctaccggccgcttgaaatcgtcacccgcccgggctcggtgctcgaccccggccccgacaagccggtggtcggcggcaatcacgagacctcgcagcgcgccgtcgacgccctgttcatggccttcgagccggtgctgggcgagcggatgaccgccggcggcaacacctcggccgggctgctgatcttcagcggccccggcccccatggccgctgggcgaccttttacgaaccccatggcggcggcgagggtgcgcgcatcgaccgcgacggcatgagcgtggtccgcgtccacctgaccaatgtcatgaacacgccggtcgaggtgatcgaggcggaatacctgctccgcctggaacgccagaccctccgccgcggctcgggcggcaccggcgcccacaggggcggcgaaggccaggtccgcatctacgaggtgctgaccgacggcatgtcgctgaccaccatgttcgaacgccggatcgtgccgccctatggcctgaaaggcggccagcccggcgccccggcccgggcgacgctggtgcggaccgacggcagccggaccgacctgcccggcaaggccaatatcgcgctgaagcgcggcgacaaggtcatcttcgagacccccggcggtggcggctacggcaccgccgccgggattgcggcggcggaatgaggacggctcctccccggtagctcccgatccgatctccaccgccctgcatccgcgggagacagcgtctcctcccctcccgtctcccgcggatgcgcatctttcgcctaaggcgaaccgcggcctgtcacgagatggaagatcaggccggcggcgctgatccccgcccctgtcaggcagacccccgaccagccggccagggcataggccgaggtcgaggcaacgccccccagcgcgctgccggcggcatagaagaccatatagcccccgaccagccggctctgcgccttcgggaaggccgcaaagatcagactctgactggtgacatgcaccgcctgaacggcgaggtcgagcaggatcaccccgatcaccagcagcaccagcgactgccccagaagcgcgatcggcgcccaggacagggtcaggatcgcgagtgcaaggccggtcgtccatccgccaaggcccctgtcggccagccggcccgcgacccccgcggcaagcgcccccgccaggcccgccaggccgaacagccccacctcggtatgcgagagcagaagcggcggcgcgcgcagcggcagaaccaccggcgtccagaatgtgctgaaggctgcgaagatcaggaaggccagcaccgcccgccggcgcagcagcggcctctgcaggaacaggaccgggatcgaccggatcagcgccccgtagccgatcggcgccaccggtgccggatggtgcggcaacaggcggcggagcatgaccgccagccccagcatcaggacggcagaggtcaggtagaccgcccgccagccgccgagatcggcgatggtgcccgagacgaagcgggcggcgaggatcccggcaaccacgccgctggtcaccagccccaccgcccgcccccgttcggccgccggtgccagcgccgcggtgaaggcaaccaggacctggacgaccaccgccagcagccccaccgcgagcatgccggccagaaacaccccggccgtcggcgcggtgcccgcaatcgccagtgccgcggccgacagggtgatctggcgaagtacaagccggcgccggtcgatcagatcccccagcggcacgacgaacaccagcccgatcgcatagccgatctgggtcagggtcacgaccagcccgatccgcgccggtgcaatcccgaacgaggcggcaatggcatcgagcagcggctgggcgtagtagatgttggcgaccgcaacaccgcaggcggcggcgaagatcggcagggcccggcgcggcagggccgtctcggtcggggaaacgggagagatggaatgggtcatggcagcatccgttgcatctggtcctttcataggacttcttgtgcatcggagaatctagttctatattagaaccagatcaggcagggcaaaagcggggggaagatgaagcggacgagcctggccggcgccgcctgcccggttgcgcgggcgctggacgtcatcggcgactggtggtcgctgctgatcgtgcgggatgccttcgacggcatccgtcgtttcagcgccttccaggaaaatctgggcatcgcccgcggcatgttgagcacgcggctgcgcgccctggtcgatgccggcattctcggccatgcccccgcctcggacggctcggcctatcgcgaatatgtgctgaccccgcagggccgggccctgttcccggtgatcgtcgcgctccgccaatggggcgaggaccatctctatgcgccgggtgagccctgctccgcacttgtcgacacgcagaccggcgcaccagtcgcgcggctcgacgtccgcgcccgggacggccgccggctcgactggacggatacggcggtgcgcggcgcgtaaccggccggagagcgttgcgcaacagggcgttccgtcgcactcacccctgcaaccggctcaaattcttcgccaccgcctcctgcatcgccgcccctgagcggcggacatggtcgcgcatggcctgaaaggctgcatcggcgtcacctgcgcggatcgccaccatgatccgggcgtggtcgtccgccgaatcggcggcgctgcgccggaccatcaactggtggaactgcatgcggtagatcggcagggtcagcccctcggccacttctcgcagcttggcattgccggccatgtcatagatcaggcggtgaaagcgggcattgtgctcgatataacgcgtgccaccttcggccgtggcctccgccgcctcggccgcgatctcgtccagacgtcggcggttgtcaccctggtcgatgttcagtgccgccagctccgccgcccgcgcctcgaccgcctcgcgcaccgagaagatctcggcgatgtcggccgcctcgaagcggcggaccacggcgccgcgattgggctgcacgtcgaccagcccctcgccgttcaggcgccggattgcctcgcgcaccggcccggcgctcacccccagtcttttggtgatgtcggccacgatcagccgctgacccggggcgaagctgtggtcgcggatgccctcgcgcagcgcgttgatggtgaagtcgacgaccgattcttccgtctcgtgtgccatgcgcgtcccgggggctgaggtcctgtccgccagatcctaggataatttcctcccataatccagttgcaccccttcggaatcgtgctataggattttattaagattttttctgaacatgtgggaggactcaatgacgaagcgtgccgcgctgcgccacctgatcgcagcacccgagcttctggtggcgccgggcgcctgggacgggctcaccgcccgcctggtggaacaggcgggatttcaggccgtctacatgaccggggccggcacggccgccgctcatggctttcccgattacggcctggtgaccggcaccgagatggcggccaatgccgcccggatggccgattgcaccactatcccgctgatcgccgatgccgataccggctacggcaacgaactcaacgtcacccgcaccgtgcgcgactacgaacgcgcgggcgtcgccgcactgcatatcgaggatcaggtggcacccaagcgctgcggccatctggacggcaagcaggtgatcccggccgaggaattcgccggcaagatccgagcagccgtccaggcccggcgcgaccccgatctggtgatcatcgcccgcaccgatgcccgcgcggtggccgatctggacgaggccgtcgcccgcgccaatgccgcggtcgaagccggcgccgatctgatcttcgtcgaggcgatcccagagatggccgaacttgcggcagtgccgcagcgggtacacggcccctgcctgctgaacgtggtgccgggcggcaagaccccgccggtcgacctcggtgcggcacaggcgatgggctatgccatggcgatctgcccggccgtgctgctgaccaccgtcctggcggcgggcgaccgggcgctggccgatctgaaggccatgggcctgcccaccgaccgtcctgctgccggggtggtcgaggccttccggcgcttcggctcgggtgaatgggatgccctgcggcgcgactatgccggaaccgcggcatgaccgccgccgtgatgccttcctcgggccagagcctggtcgacaagatctgggcgcagcatgtcatccgcgatctgggcgacggctgggcgctgatccatatcgaccgtcacatcctccacgacctgtcggggccgccggccctcggcaaggttcaggccgccgggcgccgcgtgtccatgcccgggctgactttcgccacccctgaccatgcggtctcctcgcgccccggccgcacggcagcgagcttcccgcccggcggccggctgatcgaggccctgcgcgatctcacggcacacgccggcatccgtctcttcgacctggacgaggacggccagggcatcgtccatgtcaccgcccccgaactcgctatatcgctgcccgggctgacggtgatctgcggcgacagccacacctgcacgcatggcgggctgggggcccttgctttcggggtgggtacctcggaaagcgcccatgcgctggccacccagacgctccggatgcagaagccgcggcggatgcgggtgctggtcgagggccggctcggcgcccatgtgaccgccaaagatctggcgctgcatctgatgcgtcggctgggcagcgcggcaggcgtcggccatacggtcgaatatgccggcagcgccgtgcgtgcactcggtgtcgaggcccggctgaccctgtgcaatctctcggtcgagatgggcgcgcgctccgggctgatcgcccccgacgacaccgtcttcggctggctcgccgggcgcgactatgcccccaaaggcggggatttcgaccaggcggtcgccgtctggcgggatctcgcctccgacgaggacgcggtgttcgaccgcgaagccgtgttcgatgccgcagaggtcgctcccacgatcagctggggcaccagccccgatcagtcgatcgcgatcgatgaagccgtacccgatcccgaccgggcgccggcgacctcacgcgaaggcatgcgtgcggcgctcgactatatggggctggaagcgggccgaccgctgatcggcacgccggtcgactgggtgttcgtcggctcctgcgccaatgcccggatcgaagatctgcgtgccgccgccgccatcgcccgcaccggtcgggtggcaccgggcgtcaccgcctgggtggtgccgggctcggtccgggtcaagcgcgcggccgaggcagaggggctggaccgggtgtttcgcgaggccggtttcgcctggcgcgagccggggtgcgcaatgtgcgtcgccgccaatggcgagcaggtaccgccgggcgcccggtcggtctccacctccaaccgcaacttcgtcggccggcagggaccgcgcgcccgcacccacctggcgagtccggcaacggctgcggccgcggcactcgccggccggatcgtcgacgtgaggacccattcctgatgttcgaacccgtgatccggatcaccggcccggcagcgcccctgcccgtggccaatctcgacaccgacgtgatcatccgcatcgagcgcctgacctcgggcgaggtgacggggctcgggccctgggccttcgagagcatccgataccgcccggacgggaccgaggatcccgccttcccgctcaacgatccgcgctggcgggatgcccgcatcctgctcgccggccccaatttcggctgcggatcctcgcgggagccggccgtgaatgccatcctccaggccggcatccgctgcgtgatcgcccccgatttcggcgacatcttccacgccaactgcttccagaacggtctcttgccgatccgcatggatcaggcggaagtcacgcggctgatggcggaagccgaagacggcggcgacgtcaccgtcgaccttgaggcctgcaccgtcgcctcgccctcgggcgcggtcaggggcttcacgatcgaccgggcccgccgcgaggcgctgatggccgggctcgacgacatggggctgacgcttcgtcatgcagacgacatcaccgcctggcagcagagtgaccgcgcccgccgcccctgggtctgggcgattaccggggactgtggcgttgcgggctgatcatcatttcttatgcatatcttttactaaaatcggacagcatgcccctgcaggaagatccgatgggaggagacggaccggtggatgacgccgacatgatcgagattcccgccgtgctgatgcgcggcggcacgagcaaggccctgttcttccacgagaaggatctgccgccggccggtccggaccgcgaccggatgctgctccgcgcgatgggctcacccgatctgatgcagatcgacgggctcggcggctcgcggctggtgacgtccaagatcgcgatcatccggccgtcggaccggccggatgccgacgtgatctacaccttcgcccaggtcgacaccgaccgggcagtgatcggctatgaaggcaattgcggcaacatctcctcggcggtcgcgcccttcgccgtcgacgaggggctggttgcgaccgatgcgtccgaggtgacggtgcggatctggaacgccaataccgacaagatcctgcgctcgcgggttcaggtgaagggcggccgggccagagtgctcggcgactgtgccattccgggtgttcccggtaccggtgccgagatcatgatggactatgccgacaccgtcggcgctgccacgggccggctcttcccctctggcgccgtggcccagaccatcgcgctttccgacggcacagaggtacgggtgacgctctgcgacgtcggcaatgcgggcgtgttcatccgcgccgaagacctcggcatggacggctcggaactgcccgaccggatcatggcggatccggtactcacccggcggatcgccgaggtccaggcccgcatgggcgtcgcctgcggctactggaccgactggcggagcgtcgatcgtccgggcctgccccaggccctgctggtgatgccgcccaccggcttccacacctccgacggccgccatctcaccgcggatgagatggatgtgtggggccggatgttcttcctcggcaaatgccatgacagcatgtcgggcacgggctcgatgtgtttcgccgccgcctcggccgtgccgggcacggtggtggcggatgccatgcgcgagacccggctcacccccggccgggtggtgatcggccatccgctgggggccatgtcggtcgaggtggagccgatcactgccggcgatccggccgaaacccgctatgcgcggcttggcttcgcccgcaccgcccgccggctgatggccggcaccctctacatcccccgcgacgactggccccggccggtcacactcgccgcggactgatccgcggcgcccggacataaaaaagacgacgccccatcgggaggacacccatgaccatcacccgcctggcccgcgccacggcgatcgccgctctgttcggcggaaccgccctcaccggaaccgccttcagcaccgccgccatggccgcagactggaccatgcgcatcagccaccaatggtcgcccggcctgccgaccgcgaaactcctcgacggcttcgaaaagaccgtcgaggagaagagcggcggccgcctcgatgtccagatcttccccgccatgcagctttacaaggccgaccagcagcatgccgcggtcgcccaggggctgatcgaggcgacggtgatgcccgacttcaccatgggcggcacggtgcccgagatggtggtgtcactgatacccttcctggtccgcgacgaggcctcggtgcgcgccttcccgtcatcgaaggtggcggagctgctggaagagaaactgcgcgcccgcatggtcgagccgatcggctggacggtcgagtcgcgcagcctgctgatcacctccaacggccggccgctgtcggagcccgatgccttcaagggcgtgaagatccgcggcctgaacccgctctatgacaagggtctggcggcgctgggtgccacgccgaccgcgatgccggccgccgaaatctatcaggcgctgcagaccggtatcatcgatgccacggtcaccggcactacgggagccctgggccgcaagttctacgaggtgcaggaatacggggtggtggcacccggcatctccttcgccaagaacgtcttcctggtcaatcccggctggtggcaggacctgcccgacgacatccgccggatcatcaccgatgccaccgacgagatgtggacgacgtccgtcgaggccaatctggacccgcgcgccgatccggcgatcaaggggctggagacggcggggatgaagatgacggtgctcgacgacgcccagagcgcggccctcgcccaggtcatggcccccccggtgatgagcgccttttccgagatgggccgcgatgcccgccgggtcgtcgacctgtcgcgggcggagtgagcggatgaccgccgcacccggccccgatcatcgccccgaccgccccgtcacaaggcccgatcgtctctttacacggatcgtccgatggacggtccgcctcacccacggcctcgcctcggccggactgctgggctgcctggtgctggtgggctggtcggtggtctcccgctatctcctcgacgcgccgctgacctgggtggacgacgccgtcgctttcgccctggtcgcgatcgtgaccctgagcgccgccgaagtgacccggcgtgacgaacacatcgccgtcgacctgctgacatctcgttccggcccggccggacgccggatcaccggcatcgtctcggccctcgccaccatcctgctctgcctcacgatcatctggcagggctgggcctcggccggttttgcccggatcatcggcatcacgctgggtggcacgctggaatggccggtctggcccttcctgctgatgctctcggccggcgcggcgctgatcgcattggtggcgttggatgcgctcctccggctgattctcgacggagcccccgcgccgcacgacggagaggccgcatgaccctgatcctgctgctagccgggctgatcctgctgctgctgaccgggctgccgatcttcgtggtgctgatgctgttcgccggcgcgctcgaactcgtcaatggcggggcgctgtcgaccttcccggcgttgatcgtgggggaattcgcccagtatctgctggtcgccatcccgctcttcgccttcatggcccatgtgatgatccgcagccggatcgtcgatgacctctacgataccgccttcgtgctcacccgacatctgccgggcggggtcggcattgccacggtcgccgcctgcgtggtcttcgccgccatctcggggtcgagcgtcgccaccgccctcaccatcggtgcagtcgcgatcccgcagatgctgaaattcggctacaccccgcgcgccgcctatggcctcgtggcggccggcggcacgctcggcatcctgatcccaccctcggggccgctgctgctctacggcgtgacggcggacgcttcgatcggccagctgttcatggccggcgtgttgcccgggctgctgatcgcggccctgtttgtcgcctggacggtgggcgcttcgggcctgcgcagcacacagccccgtctgccgcgcgccgggctggccgaggcggcgggcgccgtgcgccgctccttctgggcgctctcgctgccggtcttcgtgctgggcggcatgtatgccggcatcttcaccgccaccgaggcggcgggaaccggtgccattctggcgctgctgatcggcatcctgatctatcgcagcatcggcctgcgtgagatctgggcctcggtccaggacgcctgccggacttcggccatgctgttcatgattctggccggtgccgcaatgctgaaccaggtcctgaccaagatgcgcctgccgcaggagatcctgcagctggtcgccggggccgatctcggcgccatcggcttcattctgtgcgtgatggcgctgatcttcgtgctcggcatgttcctggaagcgatctcgatcatcctgatcaccacgccggtggtggcgccggtgctgcaccagctgggggtgaacccggtctggtacggcatcctgctggtgatcaaccttgaactcgcgatgatcaccccgccggtcgggctcaatctgttcaccatcaagtcgatcacccgggcgcccctgggcgagatcatcatgggcacgctgccctatatcgccatcctgatgatcggcctcggcattctgctcgcctggccggatatcgcgctctggttgccggcaacgatgatggggcgctgacgcccggtcacccccgatccgtccgcggaaggccgcgcctcccccttccatccggatctccgcggacgtcctcacgccctcgtgcattcccctgcacgggggcgtccttttatccgaattgcttttaagatcacaaaatataatcatgagttgataaagggcactggcgggagggagcgcccatgtccacgataccactgccggccgccactgcacggcggcagagcctcaggccgatcatcgcggcgacggtgggctgcctgctcgaatggtatgatttcgcggtctatggctatttcgccgtggtgatcgcgaaactgttcttccccaccggctcggactggacctcgctgctgctcgcggtcgcgactttcggggtgggttttgccatgcggccggtgggtgccctggtgctcggcacgctggccgaccggcacggccgtaaggcggcgctcagcctgaccatcaccaccatggttttcggcaccgcgctcatcgccttcgcccccacccatgccgaaatcggcctctgggcaccggtgctgatcgtgatcggccgcctgatccaggggttttcggcggggggtgaaatgggggtcgccactgcctggctggtggaatatgccggccccggccgccgcatgctgcaggcgagctttcagcagatgacccagctgacggcgctgctcgccggctcgctgaccggcgcgctggtcaccggcctgctctcccccaccgaggtcgaagcctggggctggcggatcccgttcatggtcgggctgatcatcggcccgatcggctggtacatccgccgccacaccgcagagccgccggaattcgccgcccgccaggccgcacgcgatgcccgcgccccccggatctctccggcccatgtcatccgcgcccatccgcgcgcggcgctcgccgggttctgcatcaccattctctggacgatctgcacctatttcttcctggtctatatgccgacctatgcgatccgcgaactgggcatcgccgccgacggcgcgctgatctccaatgccgtggcgctggcggttgccgtcgtcttcgtgccgggcttcgccatcctggccgatcgccgcggcccgcggccggtgatgaccgcggcggcgctggtgctgctcgcggccagctggccggcgctcgccaccctcaccaccttcccccagctgccgacgctgatcctggtccaggcggcactggccatccccatcgccgccttcaccggaccggccggcggcgccatggccggcctgtttccccctgacacccgcgccaccggcatgtccatcgcctacaatttcgccgtcaccctgttcggcggcttcgcccccttcatcgccacctgggcgatcggcgtcaccggcgacccgcatgccccggcctggtatctctgcttcggcgccgccgccgccgtgatcggcgtgcggttgatgggcgggcggcgggagtgaggggcgtgtcgctcctgagcaaagatgcagccgctgcgggtcccgggccgctttatataaataaaaagatgtatttcattgtcatatcataatttataattgatgatccggtgctcccttcctatggtgcgcaaacgcagcgttccctctgcttttccgcttgaaaaataacctatcaggttaataatgatatggagaagtggcggccgcatcatccgctgagcctcgtgcaggcgctggcccttaccggccgttttcgcatgaccggcacggcacgcgctggagcgagtcgtcttctgctcgatcagcaggacgtcctcgacatcgtaagtcagcttgcacagggcgatttccacaagagcatgacgacatatgccgatcacaccatctggcaggacgtgtaccgcccttataccccggcgggccatgtctacctgaaactcaccgtcaccgacgatctcctcatcgtctcgtttaatgaggtgtgacgtgaaatgccctgtatgtggcgcagccgagcttgtccacgatacgcgcgaccagaccttcacctataaaggcgagactgcggtcatctctcgggtggtgggcgattactgccccgcctgcggtgaatccctcactgccccggacgagaccgaccgggtcatgcgcgagatgcgcgacttcatgaagcaggtgaatgctcgtgcggtcgacccgtccttcatcaccgccgtccgcaagaagctggccctggatcagcgcgaagccggcaggatcttcggcggaggcgtgaatgcgttctcgcgttacgaaaccggcaaggcagagccccccgtcgcactcgtgaagctcctccgcgtgctcaatcgccatccacatctgctcgacgaagttcgcgcggattgagctttcagccgttgccggtggatctggtcggcggccgttgttggcggatcagacagtcaacacgagtttcgcatcgaccgcctgctcaattttcctactggaatgaggaaagttcagcaccaattggttcttatgcgcccccgcgctctacaagatgagagacgaacaggtcaagggggatcagcatgttgaaagcaggcgaagttctcggaaatattgtaagcctttcttgccttgcaataggtgctttggtcatcgtaatttcagatgtcgatgatatattatttaatagcacgtgcttaatagatttcacatgcacagatgaggtgaaaaatgggattttgaggataatcactgtccttgcaatggccactctcattccaacttctcatcacattcttaaaatcattaataatatcagaaaaaacaactcaaatattgaaaatggtgtatcaataatacttgaaaatattcacaactcaatatcagtcatagataatgataaattcgagtatttttatgaaagcgcattaaaaggcatagagaacgcagcgtatgaacagaccatcatccgagccacgtcaagcttcacacctcctgataccgagatgcgggagaagtacttcgatggtcttgctaagatcattacgcgtaaatcatcgccaaactacctggttctaatggcgaaaggcaacaacgagaaatgggatgaggagtgcctcaaggaactcgatattcgaaaaacttacatggataagcatgcagagaccaatggaagaccatggcactatgatcaggacttctctgcacggcgatcgcggtatcatgcaagaatggacttcctgatcataaaagatacagtctttctgaatgtgagtacctctgtcaaaaattccggtgatcgtggctacatatatatcaaagataatgaagttgcagatatatttcgtcgctggtttgataccatctggaaagacaatagactttcatcaaaaattgacctaaccgaacgggggtttgaattcgagcgttccaggactagataaaagatcgcctcggagttatctatatcctgaagggatgtgcagacagagcgattgccatccacatctgctcgacgaagttcgcgcggattgagctttcagccgttgccgggcagccgcccccgctccgcctcctgcaggccgcgccagtcgaccttgttggtggcggtgcgcggcaggtcttcggcgaagctgatgaagcggggcaccttgtaggcggcaagctcgccgcgggcccaggtgatgatgtcctcggccgttacccggcccttcgcctcgggcttcagcacgatcaccgccttcaccgcctcgccccggcgatcgtcgggcaccgagatgatgcaggcgtcgcggatggcgggatggcggaacaatgtggtctcgatctccgccggccaggccttgaagccgccgacattgatcatccgcttcagccggtcgacggcgtagaaataccctgccgcatcgcgccggcccagatcgccggtgcgcaggaagcgcttgccgtcgcgctcgaaaaacgcttcggcatcggcctcggggcgtcgccagtagcccttcagaatctgcggcccggccaccacgatctcgcccgtctcccccaccggcagctcggccagggtgtcggggtcgacgatgcgcgcatcggtgtcgtggatcgggatgcccaggcattgcggccggggcgcgtgcatcgggttcatatgggtgggcgacatggtctcggtcatgccatagccttcgatgaaaatcaggccgtagcgctgtttcagctcggccgccaccgcctcgggcatggcggcgccgccgccggtcagcacccgcacccgatccagacaggccgggtcgaaattgtccgatcccagcacgtcgaccaccatcgccggcgccgcgttccagaagctcacccgccggtcggccagcagcaccggcaccagatcgcggtcccagcgggtcatgagcacgatttcgcatcccgcaaccagggccgcgttcatcgaggcctgcatgcccgcgacatggaacagggtcaggaaggcggtgacgacgtcctctgcggtcatccggtagaggcgcagctgcgcctccgccgtgaacagcaccgcgagatgggtgtgcatgcaggccttgggccgcccggtcgagcccgaggtatagggcatcaggcagagatcgtccggcccgcctgcggccggcggcaggggcgccgcctcctgcgccatcacctgccgccagtcgtgccagccctcgggcagcgccgcccggccggccgtcatgaccgccggtttcgggaagcgcggatccccgcccgccatgtcgtcgtagtgcgcggcgatcaccgtctccagcgggccatccgcaccggatagcggcgcaaaactctccaccagctcgtcgcccaggatcgcgacccgcgcgccgctgtcggcgaggatgtgagagagttccgcactccgatacatcgggttcaccggcacgccgaccgcatcggccctgagcacggcatgataggcgatcacataatgcggcgagttctgcagcgcgatcagcacccggtcgccccgaccgaccccgaagcgggtcaccagcaccgccgccagccgctccaccgccgccgcgagcccggcatagtcgagcgtcgcgccgtaatagaacagcgccgtccggtcgggcaggcgggccgcggtcgcggccagggcatcgaccatggtccggttggcgacggtgagggaacgcggctcgcccgcgggccatggatcgatgcccggcgcagccgccggatcggtggcaggaatgctctcggtggacatcgctcgctcgacccgcattgtttgatcaaagatcatcaattatcttcacgtccgggccttgcggtcaatgcgcggatgtgcggtcgtggggggaatgttcatgggcaagggagagacggggatgacccgggatgcggaaaagatcctgctggtgaccggcggcgggcgcggcatcggtgcggcgacctgccggctggcggcggcggccggctattgcgtggcggtcaactatgcccgcgacgaggccgcggcaaccgcgctggtcgccgagctggaagcggccggcacccgggcggcggccttccgcggcgatatgggagagccgggtgccgccgatgcgctggtggcggcggtggtcgagcgcttcggcggcctgacccatctggtcaacaatgccggcatcaccggcaccggcgcacggcttgccgatgccgatccggccatgatcacccgggtgatcgatctgaacgtcaccggggcgatcatggtcgcccgggcggcggcgcaggcgatggcaaccagccgcggcggccggggcggcgtgatggtcaacgtctcttccgcagccgccacgctcggcagcccgggcgaattcgtctggtatgccgcctccaagggtgcaatcgacagcctgaccatcgggctgtcgcgcgaactcgccgccgacggcatccgggtgaacgcggtctcccccgggctgatcgacaccggcatccatgccgatgccggcatgcccgaccgggtggaacgcctggcccccaacatccccctcgcccgcgccggcagcccggaagaggttgccgagacgatcctgttcctgctatccgacgcctcctcttacgtgtcgggcaccattctccgggtggccggcggacgctgacagcttccgggagacgagatcatgaccggtgaagacaccagcggctggcgggcatccgccgaagcctggatccgcgaacagggtgacgacggcgactatggccgcgcccatgtgctcgatccggtcgtgatcccctggctgcgcggccagggcttccgcaccgcgctcgatgtcggctgcggcgagggccgcttctgccggatcctcgccggagaaggcatccgggcgaccggcatcgaccccaccccggaactgctggccgccgcccgcacccgcgatcccgacggcgactaccggccgggccgcgccgaagcgctcgactttcccgaggcgagcttcgatctggtggtcagctatctgaccctgatcgacatccccgacatcgaagctgcaatccccgaaatggcgcgggtgctgaagccgggcggcagcctgctggtcgccaacctgaccggcttcaccagcgcctcggccgatcgtggctggcagtatgatgccgatggctgccccgaccatttcgcgctcgaccgttatctggagacccggccgatgcgggtcggctggcgcggcatcgacatcgtgaactggcaccggccgctgtcgacctatatgcagctgttcctgaaggccggcctccgcctcacctggttcgacgaaccggcccccaccggcgggcccgcggatcaggcggcgagatatgcccgtgtcccctatttcgtggtcatggcgtggcagaagccgggctgatccggcgtggtcacccccgccggccggcggcgcccacccgccgcatcagccggcggagcgtcgaggcatcggcatagccgacccgggcggcgatctcttccatcgacagcctggtcgtctcgcgcagctccgtcgcccgctccagcctgaggcgctggatgaagcccaccggcgacaggccggtggcgcaggccatgcgccgggcgaaggttcggggcgacagccctgctgccgccgccatctccgcggccgtgaagggctggtccagccgtgcccgcgcccaggcctcggcacgggcgatgcggtcatcggccgcggccatgaaacccggcgccatataacgcgcctgggatgaccgctgatccagcagcagcagccgcgcgcaatcctgcgccaggcccggcccgccatggcgtgccaccacctgcagcatcagatccatctgcgccatcgccgcgccggcggtggtgaccggcccgtcgcgcaccaccagcgcatccggatcgagccggacctgcggatgcatccgggcgaagagcggggccagccaccagctggtcgtcgcccgccgcccgtcgagcaggcccgccgccgccagtagaaagaccgaggaacaggccgccgccacctcggccccgccggccaccgccgccgccagccgcacccccgccgcctgcacatccggacgggccagccccgccgccagcgcgtccggcgtcgcgaaccccagccccggcaccaccagcagatcggccggcggcgcatctgcctcggcgaccgccagattcagaaaggcagcagccaccccggcaccggcgccggccaggcgcaagctgaaaagccgcgtccgtcccgcctgcccgcgcagccggttggcggtttcgaccagatcggcggtgatggcaagccccgaggccatcatgccctcaagggcgaccagctcgatgatcattctggcaaaaaatcctcgaaacatgtcaatccggccactggcgaccagcatgcccgcccgccatcctgggggcaagaccagcccaccaggagacgcccccatgcacgcactggatcaggacgacgatctggcggatttcgagccgcgcgagatcaccatcgacgacgtcacccgccgggtccgggtggcaggccaggggccaggggtgatcgtgatgaccgaaatgccgggcatcagccccgaggtcgcccgcttcgcccgctgggtgcgcgatgccggcttcaccgtctggatgccatcgctcttcggccgcgatggggcggtgccggaggcggatgagggggccgcgatcttccgccgcacctgcatcgccgccaccttccgcgccgtggcgaccggcggccccggtgccgtcaccgcctggttgcgcggcctggcccggattgcgcaccaggcctgcggcgggccgggcgtgggggcgatcggcatgtgcttcaccggcaattatgcgctgtcgatgatgctggagccggccgtgctcgccccggtactctgccagccctctctgccgctggatgcgcccgcagcgatcgagagcccgcccgaggaactggccgcagtgcgcgcccggctggaccgcgagaacctcacggtgctggcctatcgcttcgccggcgatgccgtctgccgggccgagcgcttcgccgcctatgaacgcgcgttgggcaaccgcttccagccgcgcaccctgcccgacacggccgcccggcgcgagggactttcccccttcttcgcccgccatgtccccacgccccatagcgtggtcaccgcccatctgatcgacgaagccggccagccgacccttgccgcgcgggacgagattctggcctttttcgcggatcggctggcctgaatcgcgatcccggacgtcctcgatcgtgatcgaggacgccacgcggcagcagatcgggcatgacgaccgggtgtttcccatcacctgaaggccttctgcatgccccgtctgcgctcccgcctcctgctcgccctcgcctggttgctgctgggcatcaccggtgcgtcggccacgcccggtttccggaccgccacaatcgagacgccggagcggccccaccccctcaccctcgcgatctggtacccggcggccgatgacggcgcgccccggctggtgggcgacaatccggtcttccagggcgtcgcggtccgcgaggccgccacccccctctccggccgccacccgctggtcgtgctctcccacggcttcggcggcaaccgctttaaccaggcttggcttgccgtacaacttgcagacgcaggctatgtcgttgccgcgaccgatcatcccggcacctccaccttcgaccgcgatcccgatcaggcggccgcgctgtggcggcgcccggccgatctcagccgggtgatcgatcacctgaccggcgccgctgatctttccgccatggtcgatccgacccgcatcgccgtcatcggccattcgctcggcggctggacgtcggtcgaaatcgccggcggccggttcgatgccgacgccttcacccgaaactgcgccgagaccaccagcatcgcctgcaccatcctggcccggatcggccggctgtccgatcccgactggcggtcgcacatgggggcggatctggtggatccgcgcgtgagcgcggtcattgccctggatccgggcggcatcggcggcttcacgcaagccagcctcaagggtatcacgatcccggtgctggtgatcgccgccggtgtcgaccgcatccatctgccggccgaaaccgaagcccggcgcctggccgggttgctgccggaccggtcgaccgacttccacgaactccccgatgccgcccatttcagcttcatcggcctctgcaagcccggggccgcgacgatccttgagcgggaacagccgggcgacggcatcctctgccgggatggcgacggccgcgaccgcccggccctgcatgcggagacgacgaccctggttctggaggcgctggcgacggtctggccgcgatgatcgggcggtcaggcctcgggatgccgcggcagtgtgatccggacccgcagcccgcttgaagactcccccgccgcatgccggtcggtcagttccagccgcccgccatgcagctcggcataatggcgggcaagcggcaggcccagccccaccccggcgcgttcgggccgcaccgaccccgacggcatcgagaacggctcggtcacggtctgcaggcgctcggccggaacccccggcccgtcgtcggtgatgtcgatcgacacgcgatcgtcggcgctgccgtcgatgcggatccggacatggccaccgcgatgaccgtagcggatggcattgtcgatcaggaagccgatcatgcgccgggtcagacgggcatcgacatcggcggtggtgttgccgcgggcctcgatatcgagcgtcgcgccatagcggcgcagcacggcggcgcaggatgtcgccgcctcgcgcaccagcgcatccagcccggccgcccgccgttccggcgacagctggccgctttcgatattggccaggtccagaagcccgtcgatgatctgcagcagatgccgcccggccaccgcgatatggccggcatagtcgcgataggtgccgacccccacggggcccagcatctggccctcgatcacgtcggcaaagccgatcactgcattcagcggggtgcgcagctcgtggctcatatgggccaggaacagcgatttggcagcgctggcggcgatggcccggttctgcgccgccatgatttcgaactgggcccgcttcatgtcggtgatctctaccgacatcaccaccgcaccgttcggcagcccggccccgtcggtaacgcccaccgccgtcatccggaaccagcgggtctggtcgcgcaccttcagccggtattcatggctgatctcgggcagccggccggtcaccaccgacaggatcgccgccaccgcatcggcctggatcggcggcgccatgcgggccgggccggcgggttcggcgccgccatagccgccggccgcgccgcggaagtcgcggccgacctgaacatccggtgccgtctcgcccatctcttcggcgaagcggctccaggcgcggttcaccgccatcacattgccggccacatccagcagccagacctgggcggggatggtgtcgatgatcgcggtctgcatgcgcagcagccggtcggtctccccctggcggctgcgcagcacgcggttggcgagttcgcggtcggtgatgtcgatcgcagccgtcaggatcgccggccgcccttcccaatccagccgatgggtggcgatctcgacatagaaggtccggccatcggcggcccggtgccgccaggggccgctcacctcgtggccgctggcccgggtggtcagccgggtcatcagcgccgggacatcctcggccgggcgcaggtcaagcagggtcatgcccagcagggtctcgcggtcatagccgtattttccgaccatcgcctcgttgaccgacagcaggcggaaatcctgctcgtcataaatccacatcggcagcgggttggcgtcgtagagcgcctggatcatcttccgctggctggcgatgacctcggcctcgcccggcggtgccgccggatcgcgcagcacgcccagccagccgccctcgaacagccgcgccggcggcagggcccggatgctcatcttcagaacccggggcgtgccgtcgccgggatgcagcatctccagcgcctgcgcctccccctgggcggcggcccgtgccgccgcctcgcgcagcggccgcgccatgccgggccggtccagcggcggcggcagcacggccggtgccgcggccgggtcgaaatgacggctgacatggaccagacggcccggcgggccgtccaccggccgcgcctccaccaccaccacaccgtcgcggccggcatccagcgccgccgccagcgtggcggcgcgttcctcggcggccacgccctgcagcaggatcttcagctgggcgcccagatcccgggccagatctgccggcaccacctcgcccgcaccgccgggcatcatggcggccggcaggaccagggtcgccagcacctggcgcggatggatcagcaggcggatcacctgctcgcagcgcggaccgtcggccccggcatcgatgcccggcgccttccagtcgaccaggatccgaatggccgccgcattccggccggcctgccagagcgtcaccctcaccgccccggtggcgtcccccagggcagctgtccacgccaccaaggccgccgccggccctccggcatcggcagccgcatgcaacagtcttcggttgagcgcgaccggatcgatcgccatcccagactcccgccccgcagccgctggccgcgcttcgccctcgtcctctggtgccaacgatacaccggccggtcacccgcgtcatgcaggaccgtcagatgaaaaggccccggcagggcgtgcatccctgccggggccgaagacgggccggattcgttacggcgcgctgattattctgccgcgtcgggcagcttgcgctccaccggcaccggtgcctttgcggtcgcaatcttgcccagcgcgtcgaacatcggcgcgaagttcggccgcttcacatagcggccgcggccggtcttcacgtccagcgcgccgttgcgatacaccacctcacccgccgagacggtcaccgcggccacaccctcgacggtcatgccctcgaagatgttgaagtcgatgcgctgatgatgggtcctggccgaaatggtcttcgtggccttggggtcccagaccaccagatcggcatcggcgccgggcgtgatcgcgcccttgcgcggatagatgttgaagatcttggcggcattggccgaggtcgcggcgacgaattcattgggcgtcatccggccggcattgacgccgtgatgccacagcaccgccatgcggtcttcgacaccggcggtgccgttcgggatcttcgtgaaatcgcccacgcccatccgcttctgatcggcgcagaagcagcagtgatcggtggcggtggtctgcagattgcccgactgcaggccgcgccacagcgcctcctgatgctccttcgaccggaagggcgggctcatgacataggccgccgccgtatcccagtcgggatggcgatagacgctgtcgtcgaccaccagatggccggccagcacctcgccgaacacccgctggccttccagccgggcgcgggtgatggcctccagcgcctccttgcagctgacatgcaccacatagatcggcacgcccagcacctgggcgatgcggatcgcgcggttggcggcctcgccttccacctcgggcggccgcgacagcgggtgaccctcggggccggtgatgcccatctccttgatcttctgctgcagcgtccagaccagctcgccgttctcggcatggacggtcggcatggcgcccagttccagcgagcgctggaagctgcggaccaacacctcgtccggcgccatgatcgcgcccttataggccatgaagtgcttgaagctgttgacgccttcctcgcggaccagcgtgcccatatcggcatggacgctgtcgtcccaccaggtgacggcgacgtggaagccgtaatcggccaccgccttctccgcccagccgcgccaggtgcgataggcctccatcagcggctgctgcggatcggggatcacgaaatcgatgatcgaggtggtgcccccggccagccccgccgcggtgccggtctcgaaatcctcgctcgcgaccgtgcccatgaagggcagctgcatatgggtgtgcgggtcgatgccgcccggcatcaccagcgcaccgccggcatcgaccacctcggcgcccgcgggcacgtccaggttttcgcccaccgcgacgatgcggccatcggcacagtagacgtcggcccgcgtcgtcgcgtcggcggtgacgaccgtgcctcccttgatcagcaacgacatgtatctgctccttggtgacggttcggacggggttccaggcgggggggccggaagggacgggtcagtctgcggtgcggccgcgcatcagcaccagatagaccgcggccgaaacggcaagcccgacgaaccaggcatagccgtaaagatcggtccagaacggggcgactgcgccgatgatgccggccttggacagaaagcccggcaggttgggcaggatgcccagcaccagcgcgatgatggcggccgggttccagccgcccttgtaggtataggggccgtcggacgagaacagcccgtcgatgtccagccgcgtgcggcgcaggaagaagtagtcggcgatcagcagcccggcgatggggcccagcagcgccgaatagcccaccagccagacgaacagataatcgcccgcgctctccatcagcttccagggaaacatcgcgatgccgatggcggcggtgatgtagccacccatcctgaacgaaatcttcgccggcgccagattggaaaagccgttggccggcgccaccatattggcggcgatgttggtggtcagcgtcgccaccagcagggcgaacagcgccagcaccacgcccatgccgcccatgcggccggccagcgccacggggtcccagaccgcctcgccatagatcaccacggtggccgaggtgacggcgacgccgatgaaggcgaacagcgccatcggcagcggcaggccgatcgcctggcccaggaactggtcacgctggctgcgggcgaaacgggtgaaatcggggatgttcagcgccatcgtcgcccagaagccgaccatggcggtgaggccgggccagaagaccgaccagaactggccctctttggcaccgccggggccgaaggccgagggctgcgagaacatggcgccgaagccgccggcattcacataggcccagcccagcagtgccagccccatggccagcagcaccggggccgcggccttttccaaccagcggatggattcggtgcccttggccacgaaccagagatgcaggccccagaaggccaggaagcacatcagctgggcgatatcgatgcccagccccggcaggggcgcgccggtgacgccgccaccggtgacggcattcaggatcacatagatcgcctggccgccgacccaggtgttgatgccgaaccagccgcaggcgaccaggccgcgcatcagcgccggcagccgggcgccgcgggtgccaaaggatgccctgagcagcaccgggaaggggatgccgtgcttcgcgccggcatggcccactgccatcatcggcgccagcacgatcagattgccgaccagcacggtggcgaccgcctgccaccagctcatgccttccgacaccaggccggcggcgatcatataggtcggcacgcagaccaccatgccgacccagagggctgcgatcgacggccagtcccagctgcgctgatcggccgtggtcggcgccagatcctcgttccagagggcgggatcgtgcgcgacggcacgccgtgatgcggcagactgcgccgcgctcggtttcggggccgcaccgcgcgcggcagcaccgtactccatgcgatccgacatgggatctcttatcctcccgggcatgggatcgccggcagcccaccccttgccatcctccgtcgcgcgcggacgcgggggtgtgacggggatgcgggggcatggctgccggtggtcccgtgttcgtcctgcctgttcttataatctgcaccggtttcggggaagccggccccgttcttcggccttcactcgccctcggccctcactcaccttcggccgtcattcggcagcgtcgaccgtctcgggcgtgccggcggcggcgggcttcgccatcgggttgttggggtgctgggtccagttcaggtattcggtgccggcatccacccgttccatggtgatgcagttgtccaccgggcaggccagcatgcacagattgcagccgacgcattcgctgtcgaccacgtcgaaatagcgcgcgccgtccttctccgccgtgatcgcctgatgcgaggtatcctcgcaggcgatgtggcagaggccgcatttgatgcacttgtcctggtcgatccgcgccttgatgtcgtatttcaggttcaggaactgccagtcggtgacgttcggcaccgccatgccgcggaagtcgtcgatccgggcataacccttctcgtccatccagttgttcagcccgtcgatcatgtcgcggacgatgcggaagccgtaatgcatcgcggcggtgcagacctgcaccccaccgcagccgagtgcgatgaactccgccgcatcccgccaggactgcaccccgccgatgcccgagatcggcaggccgcgggtcgcggcatcgcgggcgatttcggcgaccatgttgagcgcgatcggcttcaccgccgggccacaatagccgccatgggtgcccttgccgtccaccgtcggcgtcggcgccatcacgtccagatcgacggtgacgatcgaattgatggtgttgatcagcgacaccgcatcggcgccgccgttcttcgccgcccgcgccgactggcggacatcggtgatgttgggggtcagcttcacgatggtcggcaggcgcgaatgcttcttcacccagcgggtgaccatctcgacatattccggcacctggccgaccgccgcacccatgccgcgttccgacatgccgtgggggcagccgaaattcagctccagcccgtcgcagccggtctcttcgaccatcggcaggatatacgcccagtcggcctcgttgcagggcaccatcagcgagaccacgaccgcgcggtcgggccagttgcgcttcacccgcgcaatctcttccaggttcaccgccagcggccggtcggtgatcagttcgatattgttcaggccggcgatgcgctggccgttatacgacaccgcgccatagcgcgaggacacgttcaccaccggcgggtcgatgcccagcgtcttccagaccacgccgccccagccggcctcgaaggcgcggacgacgttgtattccttgtcggtcggcggggccgaggccagccagaacggattgggggagcggatgccggcgatgtcgcaggaaaggtcggccatgacgggatatccttccgaaattcggggtcaggccgcgcggccctgggcggcggcgaaggcggcatcgatcgacagtgccgcctgcttgccgtgctccaccgcctgaacggtcaggtcgatgccgctggcgacgcagtcgccaccggcccagacgccggcgagcgaggtcgcgaagccggcatcgacggcgatccggtcgccggtcatctccagcaccgccgcgccgccgaaaccgtcgggcagcagcacctgaccgatcgccagcagcacctgatcggcagcgatcagccgggtctcgccggtatccaccgcccggccgtcatcgccggcgcgggtataggcgaattccacccccgtcacccggccattggccccatgaaccttcaccggccgcatccaggtgcgcagcaccacgccgttcgaccgggcgaaatcctgctccaccggtgtggcgctcatctgttcggtgccgcggcgatagaccatggtcacgtcttcggcacccagcttcttcgactgcaccgccgcgtcgaccgcggtgttgccgccaccgatcaccaccacctgacggccgaccggcagggtggacagatcgtcggcctggcgcagccgggcgatgaaatcgaccgcgggttccacccccgccagcgtctcgccctcggcgcccagcgcgcgcaccgcgccgaggcccaggcccaggaacaccgcatcatactcggcacgcagctgatccaggctgatgtcgcggcccagcatctggccggtcttcacctcgatgccgccgatcgacaggatccaggcgacctcgcgggcggcgaaatcatcgaccgtcttataggcggcgatgccgtattcgttcagcccgcccgccttctcgcgcgcctcgaacaccgtgacgtcatggcccagcatggccaggcgatgggcgcaggacagccccgccgggccgccgcccacgacagccacccgccggccgctgggggcggcccgccggaacagctgggttgccggcgtggtgtcgctgccatagacccattcggtggcgtggcgctgcagcaggccgatctcgaccggcttgtcgtcctggtcgtggcgcacgcaggcctgctcgcacaggatctcggtcgggcagacccgggcgcacatgccgcccatgatgttggccgagaggatatcggtcgcggcccccttcatgttgtcggtcgcgatcttgcggatgaagctcgggatgtcgatggaggtggggcacgccttcacgcagggcgcgtcccagcagaaatggcagcggctcgcctcgaccagtgccgcccgcccatgcagcggcggatgggcatcgaggaagttccggccgaggtcttccgccggcagacggccggcccggatgtcacccgtctcgtccatgatgaagctcgtccttcgtctgtcattggttatcggccggggctctctcaaccaaggatggagatggtggaaccacccccgcccttcgcgggtccgccggtccgttgcccctgcggcaccctcaggcgccgcagggggtcgtcacgtccttgaaaaaaccctgtatcaggccgcgtcggcggcagcccccgagccggcattggcccgttccagcatcgcgcccagcagcacttcggcgccggccgcaacccattcgggcttcgcatcctcgatctcgttgtggctgatgccgtcgatgcagggaatgaagatcatgcccgtgggcgcgaccttcgccagatagcaggcgtcatggccggcgcccgagacgatgtcgcggttgctgaagcccgcggccgcagtggccgcgcgcacggcgttgacgcagccctcttcgaacggcaccggcgcgtagtagaagatctgctcgaccttcgcctccagcctgccgtcggccaccacctcgtcgatggcggcgcgcagctcgcggtccatcttcgagagcacgtcgtcatcggggtggcgcaggtcgatggtgaagaacacccggcccgggatgacgttgcggctgttgggatgaacctgcatcagccccaccgtcgcgcaggcgaccggcgcattgtcgagaccgatcttattgaccgcctgaacgatcttcgccgcccccagcagggcgtcgcggcggatcggcatcggcgtcggcccggcatgggcctcctggccggtcagcaccacctcgtaccagcgctggccctgggcgtgggtgacgatgccgatggtcttgccctcggcctccaggatcgggccctgttcgatatgggcctcgaaataggcgccgaccggcttgcccaccggctgatcgccggcatagccgatccgctccagctcctggcccatggtcttgccgtccagatcggcgcggctgaggccgtaatccaggtcgaacacgcccgcgaacacgcccgacgccaccatggccggggcgaagcgcgagccttcctcattggtccagaccgccacctcgaccggcgcctcggtctcgtaattgaggtcgttgagcgtgcgcagcacctcaagacccgccagcacgccatagacgccgtcgaaacggccgccggtcggctggctgtccagatggctgccggtcatcaccggcggcagagacgggttgcggccttcgcggcgggcgaagatgttgcccatcctgtccaccgtgatggtgcagcccgcctccttcgcccatttcacgaacagatcgcggccctggcggtccagatcggtcagcgccagacggcagacgccgcccttttcggtggcaccgatcctggccatctccatcaggctgtcccagagccgctcgccgttgatccggatgttcgacatggtgtgatcgtcccctgatcctgtgtctcgaatacgatgcgatgagatgagtctacacccgtgccgcacgggcggcggcatcggatctgccgtgcccgctcatcccatcgtcggaaagttgaactgcgcgccggcgcggatgccggtcggccagcgctgggtgacggtcttaaggcgggtgtagaacttcacgccctcgggcccgtagatgtgatgggcgccgaagagcgagcgcttccagccgccgaagctgtgataggcgaccggcaccggcagcggcacgttgacgccgaccatgccgatccggacccggctcacgaaatcgcgggccgcatcgccgtcgcgggtgaagagcgcggtgccgttgccgtattcatgggcgttgatcatgcccaccgcatcttcgtaagacccgctgcgcaccaccgacagcaccgggccgaagatctcttcgcggtagatggtcatgtcggtcgtcacccggtcgaacagggtgccgccgacgaaatagccgttctcatagccctgcaggcggaaattgcggccgtcgaccagcagcttcgcgccctcttccacgcccttgtcgatatagccgcgcaccttgcgggcgtggatgtcggaaatcagcggccccatttcggcggcgctgtcggtggcgggccccaccttcagcgcttccacccgcgggatcagcttttcgaccagccggtcggcggtctcctcgcccacaggcacggccaccgaaatcgccatgcagcgctcacccgccgagccgtagcctgcccccatcagcgcatccaccgcctggtccagatcggcatcgggcaggatgaccatgtggttcttggcgccgcccagcgcctggacccgcttgccggccgcggtgccggtcgcatagacatattcggcgatcggggtggagcccacgaagctcaccgcctcgatccgcggatcggtcagcagcacgtcgacggcttccttgtcgccatggacgacgttcagcacccccgccggcaggccggcctcatgcgcgatttcggccaccagcagcgccgcactcgggtctttctccgacggcttcaggatgaaggtgttgccggcggcgatcgccagcgggaacatccacagcggcaccatggccgggaagttgaacggcgtgatgccggccaccacgcccagcggctcgcggacatcgaaactgtcgatcgccgggccgacattgcggctgtattcgcccttcagcagctgcgggatgccgcaggcgaattccaccacctcgatcccgcgggccacctcgcccagcgcatcggcatgggtcttgccgtgttcggcgctgatcgcgcgggcgatctcatcggcacgggcatcgagcagttccttgaagcggaacatgatccggccacgcttggccggcggggtcgccgcccaggccgggaaggcctccgccgccacgccgatcgcgcgttccacctcggcccgggtcgcaaggccaagctcggccgtctgctcgccggtcgcggggttgaagaccgggctgcggcgggggccttcgggggcgacgcgcgcgccgccgatcagatgctcgatggtccgggacatggggtggtctctcgtcctctgcgggccgcccgggcggctgaacgctgccgggcgggatgtttgcggggggctgtcgtaagacgggccggccggcacgggccgctcccggggcccagggcacgactctcccgtcgcgtcgcgggcaggccgcagacggaaatcgggcgtcggggcataggggccatgcggcggatggcagccgccggaaacgacgacacggcccggcccgaacgggtcaggggtgacgatcatcccgcaggcggatcacccggcatggggcatccgaagatgggtcagtcgaagctggtcattctcaaagggcctcccggcatatcggtcgaaacgggtggagggtgtccacacgcccgctcggctcggccatactgctccactgtcagacggcgccgggtctctcccaccggtgctcgccctcaccgggccgcttgacgcggcctctgtcttcctgatcctggaacgatgtgcgcggggggcgcttcaccggccaggcgggcgacgtgaccgttctcgatcttcatcgcctgaagaacaggttagacgtatcctgaccaagcggtcaagatgtcctgaacgggtttcgacagatcggtccgcatcgcgcgaccggtgtgccattgcctcccatgcccggcccctatgcctctgcgctctgccccacctccatcttcccaaggacgcccccgaccgatgcccgaccccgccggccctgctcccgcccccgcccggcagtccctgccgcgcaaggcccagatccgcgaggagaacaccgtcgccattctggccgcggcggaagaggtcttcgccgagatgggcttccgcggggccagtacggcggcgatcgccgaacgcgccggcgtgcccaaggccaatctgcactattatttccgcaccaagaaccagctctacgcccgcgtgctggaaagcatcatcaccgaatggttcgaggccgccgaccggttcggcatcagcgatgatccggtggaagcgatcgaccattacgtccgcgccaagatggagctgtcgcgcacccggccggccgcttcgaaggtcttcgcgaacgagatcatccacggcgcgccgcagctgatggtctatttgcgcaccacgctgcgcaactgggccgccacacgtgccgccgatatcgagcgctgggtcgctcagggccgcatcgacccggtcgacccctaccacctgctgttcatgatctgggcggtcacccagcattacgccgacttctcgtgccagatccaggcggtgctcgaccgcgaccgcctgccccgcgccgaattcgatcgcgcggccgagcagatcacccggatcatcgtcaagggcatcggcgcgctggaacggcgggaggcggcagaggcggacgcctcgaaggggacggcggcatgaacggccggatcgggcgcgccggggcggacgagatcggccggatcgtcgcccgcatcgccgccgatgagatcatgccccgcttccgggccggcatgacggccggggccgacggcatcgacgggctccgccagaagacgtccgccttcgacgtggtgacggcggcggacgaggcgaccgaacgcgcgctcggcaccgccctgctccggatgttcccgggcgcggtgctgatcggcgaagaggcggcggatgccacgggcggtgcaccgcccgcagacctcatcgccgcggccgacctcgccttcatcatcgatccgctcgacggcaccaagaatttcagctcgggcctgccgctcttcggcaccatgatcgccgccacgatccgtggcgagatcgtcttcggcctgatccacgatccggtgaccggcgaaaccctgacggcgctgcgcggagagggcgcctgggccgccacggccgagggccacccccgcgatctccgcgtcgccgcagccgggccggtcgcgcggatgcatggcgttgccggcaccaacttcctgccccagccgctgcgcggccgccttgcccgcaatctcgaccgggtcggcccgaatttctggctgcgctgcgccgcccaggaataccgcctcgccgcctcgggcggctgcgacttcctggtctacaaccgcctgatgccctgggaccatgccgcgggctggctgctccaccgcgaggccggcggccattccgcccatttcgacggcaccccgtatctgccgacccacaccaccggcggcctgatctgcgcgccggacgaggcgtcgtggctggcgctccgcgaggcgctgttcggggaagcgggcaactgacggggcgcctgccttgtgcaaacctccgggagcaacatgctgaagcatggagcaaaaccccattgaacttcaggtagctgaaattcaaaggaaattcacgccgcgaacctcccggggcttttacgcgtgctcggggctcgcccagacccggggcccgcgggccgttcagatgatcagcggcgcgtcgaaatcggtggcgggtttggcgccgacatgttcgaccttggggcgccagttggcgcccaggcgatagaagcgcaggctgtcctggtcggggtcgatttcggcgatcagacgggcgcggagcagggtccattgggccgggtcgacatcgcattcgaacaccgaatactggacgcgctggccgaaatccttcaccgcccgggccacacggcgcaggcggcggcggccggcggccgtgtcggtgcggacgtcgtagctgaccaggaccatcatcggcggggtctccctgatacgggcggcgtggagcggaggagacggtcagcgcggcagccagggcggataggcatccaggtcgccgcgcagggtgcgggccagcagcagggcctgaagatgcggcatcagccccagggcggcgctttcgcccagatagggatgggtggcggtctcgcgcttgcgctcggtccaggcgaccagcacgcgcttgcgggcctcgtcgcggatagtgacaccgccggccgcgtcgtggacgaaatccttcgccccgagttcccgtcggttgatcagggtgagcgccagccggtccgccaggcgcggacggaattcctccatcagatccagcgccagacccggccgtccgggccggtcgcggtgcaggaagcccaccgccgggtccaaccccacgctttccagcgccgagcggcaatcatgggtcagcaggacatagaggaaggaaagcagcgcattcaccgggtcgcgcggcggccggcggtttcgcccggcgaactgcatggcgggctcgtcgctgcggatcagggcgccgaaagcctcgaaatagcgcgccgccgcctcgccctcgatgccgcgcagccggtcgagccggatcatgacagggggatcatcccgcgcggcatcgggatcggaggtggaggcggccagcgcccgcacccggcgcagcgcatcgccgatcgccgcctcgcccgccgccagccggtcgcgggcggccgcgtccatggtctcgccatggtcgcgcaggccgcgctgcagcaccgcccgctgaccgtcgagcttggcggtgagcagagaggcggccagatccgccccgcggtcggggtcgtcggccgcgcgatactgggcgcggcgcagcagcacattgcccgacaccggcccttccacccgcgcctgaaaccggccgttgcggtcgagcatgctgaccgtgatcccggcctcggcgcaggcggcgagcagcggtgcggtgaagctgaccaggccgatcccgaccacggcccccagcagatgcatcggcacccggccgatttccgcctgatcgagccggaccacgagattggcgccgtccttcaccacccaggcgtcctgggtggtgacatagagcgtgttgagataacgcttcacggctccccctccccatccgcatcgctgccgagccgggcgtcgatccagccggcgaccgcccggccgcgggcgagcgcctttggccggcaggtgtcgatcagcgagcaggcatcgcagcgcttgcggtcatagagcgcgggcggtgtctgccccgcggccaggcaggcggcggcctcggcggcgatgcggcgggtcaacgcgcgcaactcgtcgtcgaacatcaccgccagccgccggcgggtccggccgtagaacagcgccccctcgggcaccgtcagcccgaacatctcttccagcgccagcgcctgggcgcagagctggacctcgtcggcccgatgggccttgggccggccgagcttgtgttccaccggcagggccgccaccaccctgcgccgctcgatggtcaactcgaccacatcggccacaccgtgcagcgatggattgcggcagaccagcgccagcgacgtcacccgcttcacgcccttgcgcgcctcggccgtgccccggtccaccgcctcatgcgccacccggccctcggcggtgagcgcattctcggcccagatccgctcgacatggatcagggcgaactggcgcgggcagaccatccagtgctgcagccccgagatgggcagggagggcgcatccgtctcgaccgtcatcgctgcgccctccccttcggtcggatacaggcccgcggatcagatcatccgctcgaccgtaatcccctcgggcagcccgtcggtatccacctccacgcggtagtcgtcgaagctgcgcggcgggcgggtctcgtcgggggtggcgcgggtgacggtcacgcgcttgaacagcctgtgcgccggggcgttgccgatggcgctgtcatgccggaacaccaccagttcgcgcgcggtcatctccccgcgtgcggccgagcggtcgtgatcgaacatgttctgcagcgccgcccagaacaaggcgaggtcgtcgtccgaaaagccggtccgccccgccagatgggcgctgatgaagccatgggcgcgatagaggccatagggcacgatatgcttgcggcccatggtgcggatgtcgttcttgcccggctcttccttggtcgcggccatgcgggtgatcgagatttcgagcggcatgatcgggtcgatcgaggtcgcgaaggtcagctggaccgggccgcggacctggccggtgttcgtctcggtggtcatcaccgcaccgaaggtgcggatgtcgaagaaattggcgcacatccaggcggtcaccgcgcgcgcctcctcctccttcttgggcagcttcttcggctcggatttgatgtcgagcgccttgtaggcccgttcgtgctgctcgttcagatacgagcgctcccgcatgtaaatctcatggccgggcgtgctgccggcgaccatgtcgacaaaattacgcaccttgcgcttcaggctgacatcggtcaccagcccctgattggtctcggggtcgagccgcggcaggttgccggcatccgggtcgccattggggttaccgttggtgacgtcgaagagatagacgaaatcatagcggttgctgatcgcggtcatgggaaacgggcgctttcgaagacggggctcatatcctgaaacagggcgatggggcgatcaggcgtcgtcgccgatcacggccggctcgccggcctctgcggccttcacctcggccggggcacgggtcatcatcgcctgacgctggtggaaatagccgatcgcgaaccggccctgatcctccacccccagatggcggggcaggttcgagggcaggccgtcgatcacctcggcgatggtggtgtcgtaccagtgggcgagaccgccgcgatccttgcgcagcttcgccgcatgatgggtactgccccgcatcagcaccgggaagatcgacccgggcgtcgccgaggccgcgccatagaaccggtcgcggatggtggcgttcagccccggcagcgccgcccgctgaaggttctccagcacggcaaacagccgccccagccggtagccggtattggtttcggcaggatccagactcacgagatcgccctccctctccagaggttccttgcccgaccgccggagcagccaggccttgagcatggcgaccctcagggcggaaatctctccgtcggcgcggatgcgcatcagcgccagcgccgccatgttcgcggggtacgggcggccgctcagcaccgcccgcatgatgtcgccgccaagcttcggcggcaggttgtcgagcttgccctgcggcgccagggccttcagcagcgcatagaccgacaccggccgccccggatcgatgccggggtcgaggcggaggtcgtgccagtgctggcggacatggtcgaccgcatcgcccagccggtcttcgtaccagaagcgcagcgccaggcgtgcggcattgggcgccagccccagcacccagagccgggtgtcggggtcaagatccgccgagatcgcctcgcccatcgtccggccgcgggcgagcgccgagagcgcggtgcggacccgcttcgcctcctcgtcgctcatcttcaggtcgatcttgggcttctttgcggtgccgtcctcacccgcctcgtcggcctctgcgcccgcatcctggtccatcagcccataagcgggggagacggcattggcgagcacgcggcttgcggtgtcgtcggcggggttgggggcgtcggtccagaacaccgtggtcgcatcgccgatctgcacccgatgcgcgccatccggcgccagcagcttgttcagcaccgcgccataggcgaaggcgacccgttccgaaatcggcgcattcgccccctgttccttgccgaaggaggtgaaggcatccaggttgaacgacaccagcgaggcaccggaactctgtgcgccgcgcacgcccttgatcgaggggtgcagtttggcgatcggggccacgatgccgctgaccaggcagcgcccggccgcccccgcaaccgcctcgcgccgggctgcccaggcagcccgggccgcacggaagcggtgcagatcacgcacggtaccgcggccgaagcggaaaatgagattgccgtccaccgcctcgatcggaatctcgccggcttccaccgccgccaccgcccgttccggcgtccagtcttccaggaattccaacagcttgagcagagcccgatcctcggtccccgccagtgcctcgatatgcagctgccggaaggcgtcgaactccttcccggccgccaccacaccggcatccggcgtcttgccggcgcgcttcacgcccaacacataggcggatttgtcccagaggaaattggccgccacgcccgaggtgcgcttgatcgccgccggcacggtcatgcgcagcggtttcggcttcttgccgctgcggtcgcccagcagcagcaccggcggcacgcagcccggctggaaccgctccagatcgaccgcggcatcgatcgcctgttccgacattccctcttcgggaagatcggtgtccccgccctcgatccggcggtcgtaatactcggacagctgctgcaggatcacgacaccacctcatccgactgcggcggcggcaccgtgatcacgccgtcgaccatccgcgcccggaagaaacgcggctgcatgccccgggcatagtcgatgtcatagagcatccagcccagatcgcgcgtgccggccagatccgcatgcggcaccggctcaccctccaccggcccgaaatcggcggcgaattcgcgcgtgcccaggcagggctgctgatagcactgcccgcgcgccagccgccggttgaagatgtcgagatgcttgccttcattgtccgacggccccgccgctgccgtcagctcgaaatgggcctcgatgatataggccacatcgcgcagcaccaccgaggcgcgctgctggcggtcttcctcgacgatggtgtagacgcccgcggtgctcccggcggcgcgcgcccgcttgaccaccccggccgcgatcttcgagccgacctcgttgcgccggatcgtctcgaaacggatcgggttgagcacgatgatccggtcgatctgccagcggactgccggcttccagtggatcgcctcgatgatcccacgcgcggcagaaggtgtaatgacatcatatgacacgcgctccaccttcatctccgggcgtgtatagagtgcacgcggcccggtgacgtggagccgaacgccgaaagccatcatcctcacctttcagagggagaagacatgacgggccgttgggggccgacatggccggcccccggatgaccgtcttccaaaaacatcagtttcaacccacagccaatgcaaaatatcggccgacagatcaccttgtcaccacatcattcccttttgatggaatgagcgtcaagcgctatttctgttgattttgaaaacgtcagaagagcagtttttccaccgcgacgaacgccggctcctcccaaaccaacccgacatcctcgcggtacaggctcgggttggtcagaaccatgaactgctccccgtaccgttccccacccaccacacgcgccgcacttgcctccaccagcatcttccggatccgcggcggcagggtcacgacatggcgttgcagcagccgtgcggccccgccagcgccgccgaagcggtcgagggcggacgggtcggcggcatccagcgccgccacgcaggcttcggcctcgggcgtggtcgggatgatcagcggcagcatgccgtcctcgatgatccggtatctttcggcgacggtggcgaaggggatggcgaggcggtgcgggctgtcgtgcagcgccatgatgttttcggcatccagcatgtcgagcgcctgccagaacagcgcatcgaaatagagccgcatggcctcgggcgagagcgggtcgtcgatccggtcctcgaccatccgcccgcgcgccacggccgccgccgccagggcctgggccagtcgtctgggctggtcggccgggtcggcgggggtgaaaacctcgaccaccccctcccggcccagccggccctcgcggttgcagcgccccgcggcctgggcgatcgaatcgaagccggcggcggcgcgcagcaccatcggcaggtcgatatccacgccgcattcgatgacggtggtggagacgatccggcaggtgtcgcccgccgccagccgggcgcggatctcgtccagccgccggctgcgatgggcggcagtcatcagggcagagaggtggaacgccccctcgggcgccgcggccgccagcctctcgtagagccgccgggcatggaggcgggtatcgaccacggccagtgcccgggggccggtcgtcagccgcgcgatcaccccggcatcgtccagaatgcccgcctcccgcacgcgcacccgcgccagccggtcatgcagggccgaggggtcggagacgatctcgcgtaccgcctggaacccgccctccagcccgaacacctgggcgtattcgtcgacgacctccgcagtgccgtcgggcgccaccagcaccggctgcgtcgccgtcgccagcaccaccgtcacccggtaatttgccgccagttcgtcgagcatcgccaccgtcgggcgcagcaggccgcggggcatcatatgggcctcgtccaggatcaccaccgagcgcgggatcgcctgcaatttgcggcagcgcgccgggcggtcggagaacaggctttccaggaactgcaccgcggtggtgacgatgatcggccggttccagcgctccatcgcccggcgcagcttgtcgcggccctgccagcgttcccgtgcctccggcgggatgttgcggcggtccagatcggcttcggtgtcgaaggcgctgtgatgttccagcacctgatcggccagatcggcccccagcgccttgcggatcaccccggcggtctgctcgatgatcgaggtataggggatgacgatgatcacccggtcgagcccgtgcgcctcggcatgggccagcgcgaaggcgagcgaggccagcgtcttgccgccgccggtcggcaccgacagcgagaacacgccctgccccgccgatgccgccgcccggcaatcggccagcacttcggcgcgggcggccaccacccgctccgcccccgcctgcccggcggccctggccgcggcatcggcggcgagaccgtcgatgaacccgtccacccgcgcccgcagcaccgcaatcggggccgccgcgaggcccgcctccggatcttcccggccctcggcggcggcatggaaggcggcggtgtcggcgtaatcggcatccaccaggcaggagaacaccatccgggtcatcaccgcgaagcggaagccggcgcggtcgtccggcgcctcccccggccgcggcggcggcaggtggcgccagctctcatccggttcgggcggcgtgatctcgtctttccaggccgaggcatcgtcgagcggcttcttctccactcgctcccgcaggctgccgcggccgccatcgccctgatcctcgaaatccgccagcccggcatgatgcccggccacggcatagagcaccgcctgtgccccgggcagacgcccggccagcccgccggcgcggtcgcggatcatctcggacatcacccgcgccccccaggtcgcatgatcgaccttggtcacgtccccgcgcagccgcgcctgaaacgccggagaatacttgcccgtgtcgtgcagcagcccggccgccccggcgatactcccctgcccgaaccgcgccgcgctcacccccgccccagcccccaccgcccgcagatgatcggccagcagatgccaggcggtctcgggccggtccttcagcgaatgggcataaaacggcatgtcacgaccgcatgcggggaatgggacggcatcaggttacgatgcgatcaccacacgtgcaaggcggggatatggggcggatggtcgcgccatgattcagatggagaatggggaaggcctgccgatatcgggtatgacttcccgaagaagaccccataccgataaagcctccccatttccagggtccggggcggcatcaggccagctgcccgaaccccaccgccgcgatgaccagctggacgacgttcaggatcacgcttgcccggtgcagccgcgcgaagcggcggccggcggcaaggtcgccggcaagctccgcatcgcgggcgcggttcactgcgggcagaatgccgtggcgggcgatcagcccaagtgccgccaccagagtgaagagcagcgccggcagccagcgtgcggcgaaggccgcggcaagggcggtgacgaagccggtcaggatgatcagcaggtaatagcgcggaaagatccgtcggatcagccgcgccgccggctgcggctccagcgtggtgaacaccgtcggcgccacgatacctgagaagaacaccatggcgcccagcatgacggccgacagatagagcgccacaagtccgggggcgtcaatcagtccgggggcatcgatcatggcggcctctcaccttgtttgccggtcgggatctcctgttcagcttcagatatggtcaaggttgcccggatcggctgcgagcatccgggaacaagccggtgtcaccatcggtcgattgccgggtcagtactgcggcaggggcagccgatcgctttcctctgccaccgccggaaagcgcggatcgcccgaggcccagtcgcgtttggcatcctcgatcagcgccgggtcgctggcgacgaagttccaccacatcgaccgcggcccatccagcggcgggccgccgatcagcatcacccgcgccagaccgccactcgcctgaagccgcggccggctgcccgcgcgcagcaccgccagcatgcccgcctcatggggttcgccgtcgatcagaaccgcgccgtcgatcaccaccagcccgcgttccggtgcggcatccggtacctcaagtgccgcgccgtcttccagcgccagatccaggcagagcgcgccacccggcgcctcgaccggcgagcgcgcgccataggcctcccccgccaccacacgcagggtgatgccggtgccgatgcgcagctcgggcaggtcttctgcggcatgatgggcgaagccgggcgcaccctgctcttcgggcttcggctgggccagccagatctgcaccccgtcgagcaccgatcccccggggcggtcttcgggtgcggtgcgttccgaatgggccacgccgtgtccggcggtcatcaggttcaccgccccgggccggatggtcgcgaccgtgcccaggctgtcgcgatggacgatggcgccctgaaacagataggtgagcgtcgcgaggccgatatggggatgcggcggcacgtcgagcccggtgccgggcgcaaagccgaccggccccatccggtcgaagaacacgaagggcccgatcgcgcgccgcttggcataaggcagcagccgggcgacgttcagcccgccgatatcgcgcacccgcccgcggatcaccatctccaccgccgggcagccgccgggggcggcctcgccggccatctcgtcctcgaacctgctcatgggatccgtcctcgctcaaagcccgttatcagcttgaggctagcccgcaggtcccggccgcgatagtcccgacggcggtgacgcagtgtcaacgcgcgggcaccaaacgccaatgctcaggcaccgatggccccccgccggtcgcgcgcccaggcggccggcgacacgcccaccagatccttgaaacggcggctgaaatgggcctggtcggcaaagccggtctccagcgccgcctgaaccgtggggcagcccgccgccagcagccgcttcgccgcctcgaccctgagctggatctgataggcatggaccggcagccccaccagacggcggaactggcgcatcagatgccaggggctgaggccggccacggccgcgatctccgccaccggcagatcttcggcgaagcggtcccggatcagggcccgggcccgctcgatctcgggcgaggccgccgccgcagagacccgcatcctgcggccgctgccatggcgggcgaccagcatcaccgccgcctcgcgcagcagcacgtcgcgggcgagccgggtttcgggccggcacagcgcctgatgggtggcaatcaggcgggcatgcagcccggcatcctcgatcaccgcacaccgaaaccccacttcgggcgcatcgccgccggcaacgccgccgccggggccgaagccggccgcggcggcggcctcggtcagcagcgccatgggcagatagagcgcgcgatagcgcagctcgtcgcccaccacccggctgccggtgtgcagatcccccggatcgaccaccgagatccgcccgggggcggcggcatggatgctccgttcgcggcggaactccttcaccccggcctcgatcagccccagcatcagcgtgtcatgggtatgggggcgaaagcggtgccggcgcagacgcgtgaatgtggcctccacgccggtggtgccggccgcgaccagccgcaccccgtcggcaatgccggcatagccctgcgcaggatcggacaagaccggtccctggagatcgctaggctgatccgcccgtcccccatctccggcgaggttacgccccatgttcgcgcatcccgattcctggcctgaaccctcgaccggttccgatccctggaccctgctgtcgcatgccgccgtcaccccgccagagggctcggtgccgatcgccccgccactctatcagacggcagccttctctgccgaggatgccgaaggtttcgcccggatggcgacgacgccgatgcatgagggcttctacacccgctacggcaaccccaccacccgcgccctggaacgggcggtggccgccctcgaaggcagcacggccgcggttgcgaccgcctcgggcatgggggcgatcacggccgtgctgctcgccttcgcaggcgcgggcgatcacgtggtggcgcaacgcctgctctatggcggcaccaccggcctgctcacccgtctggcgccgcggctcggcatcacggtcgatctggtcgatcaggacgacaccgccgccttcgcgcgggcggcccgtccgaacacgaaactgatcctgctggaaagcccctccaaccccctgctccggctgaccgatctggccggtgtggcggccttcgcacgcgaccgcggcatcgtgaccatgatcgacaacaccatcgccaccccgctcaaccagcggccgctcggcttcggcatcgatctggtgatgcacagcgccaccaaatatctgtcgggccatggcgacgtctcggccggcatcgtcaccggccgcgccgacctggtcgaacgggtctggcacgaggcgcatctgctgggggcgacgcccgatcccttcgcttcatggctggtgctgcgcggcctgcgcaccctgcctatgcgggtcgcccgccagaacgccacggcgcttgcggtcgcccgccatctggcggcgcatccgcggatcacggccgttcattacccgggcctcgacggccacccgcagcgcgatctggcccgccggcagatgcccgagggtgccggcggcctgctctccttcgaggtggccggcgggctcgatgccgcagaggccatgatgtcccggctgcggctgatccgccgctcggccagtttcggcacgccgatgacggtcgcggttcatccggcggcgatgtggtcggcgatgatgacgccggatcaactgaccctgacgggcctgcccgccgggctgatccgcctgggcctgggcttcgaggatccggcggcgatcatcgccgatctggatgccgcccttggctgagggccgccttcagcgccccagcacctggtccagcacagccaccccgcgccggatcgcggccgggtcgagcccggcatagccgaggatcagcccggccacctccggccggggggctgccggatcatagagggccgagaccgggtagagcccaaccccggccgcagcagcggccgcaatcacggcggcttcgtggccggccggcacgccgtccagccaggccaccagatgcaggccggtggcggcacccaccacccgcaccggcagccctgccagcgcatccagcagcacggcgcgccgggcagcattgcggcggcggatggcccggacatggcgctcataggcgccgctttccatcagcagggccagggcctcctgctcgatcagggctgtgtgccggtcggtcacgcgcttggcctcggcaaaggccggagcaagatcggccggcacgaccagatagcccaggcgcagcgtgggcgagagcgtcttggagagcgtgccgatatagatcacgcgcgccggatcggccgtctgcagggcgggcacgggcgcaacctcgtggcggtattcgccgtcataatcatcctcgatgatcaccgccgtctgcgcccgggcccaggcgagcagcgcccgccgccgtgccgccgacagcacgcctcccaaagggaactgatgcgagggcgtgacataggcgagacgggcgggcggcagatggtcggtgttcaacccctcggcatccaccggcaccggtatggccgatccgcccgccgccgcaaaggcccggcgggcgagcagatagcccgggttttcgatcaagacgcggtcgccgggatcgagcagcagccgcgccgcaagatccagcgcctgttgcgaaccgttgaccacgatgatctgcccggccgtgcagcggatgccgcgggcccgccacagatacccggccagcacccggcggagcgccgtcgccccttgcgggtcgccataggccagccggtcggggcggcgcagcagcaccgcggtcatcgcccgccgccaggccagcaccggaaaatcgcgccccgccagatcgccatagcggaaatccgcaatccggaacgcctgcaccggtgccgggggcggcatctcggcaagccgccgggcaaaggccgacagtcgccgcggtggggccggttcgggcgccgccggcaccacgtcccggcccagccccgcggcgacttcggcccgtgcccccggccgggtggtgatgtagccctcggccaccagctggccgtaggcggcggtcacggtcgtgcgcgacacaccccattcggccgcaaaactgcgggtcgacggcaggcgctcccccggctgccagaccccctcgtcgatccgcgcccggatcgccgccacgatccggcgggcgatgccctcctcgtcaaactggcccacctgttttctccggaaccggacattcctgccggtccagactcgcggcattctgggggtgcacgcaagggagtttcaccatgtacaccccacccgccttccgcatcgacgaccggcagaggcttgtcgccaccatccgtgacgccggtcttgcgaccctggtcaccgccacggttgaggggctgatggcgaccccgctgcccctgctgctggacgagaccgaagggccccatggcacgctctacggccatctggcgcgcgcaaatccgcaagggcggctgcccgccatcggcggcgaggcgctggcgatgttcagcggccccgacgcctatgtcacacccgccttctatgccaccaagcaggagaccggccgggtggtgcccacctggaattatgtcgccgttcacgcctatggaacgctggaactgttcgacgatcccgaccggctgctgaacctggtccggcgcctgaccgagcgccacgaggccagccggccgatgccctggtcggtggccgatgcgccggaagatttcatccgcgcccagctgcgcggcatcgtcgggctgcggcttcagatcagccggatcgagggcaagtgcaaggccagccagaaccggcccgccgccgatcgtgaaggcgtcgcggccggactggccgcaagcgaccgcccggcggatcgcgagatggcggcgctggtggcggccgcccccccttaaaaggtgccctccccgcacaaaaaaagcccccggtcttgcgaccgggggcggtgtgcggaacgggcggccggaggggatggaaggcggccggcccgcaccacaaccaggcgtctgcaccgggagggtgcgggttcccgggccgcggcgaggcgccacagcccgcaggtttcaggaatcagacatagggtgccgagcgggcggcaaggctgtcgcgggcggcggcgtattcgcgcttgaagcggtcgaccagctcgcccgccgacagcacggcatcgatcgcgccgatgccctggccgcagccccagatgtcgcgccaggccttggacttggtgttgccgcccgagccgaaattcatcttggacgggtcgctgaccggcagattgtcggggtcgagaccggcattgacgatgctgggcttcagatagttgccgtgtacgccggtgaagaggttggtgtagacgatatcgcccgcgccatgatcgacgatcgcctgcttataggcctcggtcgcattggcttccttcgtggcgatgaaggccgagccgatataggcgaggtcggcacccatcgcctgcgccgccaggatcgaggcgccgttcgcaatcgagcccgacagcgccagcggcccgtcgaaccatttgcggatttcctggatcagcgcaaagggcgaccaggtaccggcatggccgccggcgccggccgacaccgcgatcagcccgtcggcgcccttctcgatcgccttgcgggcgaaggtgtcgttgatgatgtcgtgcagcaccacgccgccataggaatggatcgcctggttcagctcttcccgcgcgcccagcgacgagatcaccaccggcacctcgtatttcacgcacatgtcgatgtcgtgattgagacggtcgttggagcgatgaacgatctggttcaccgcatagggggccgagggacggtcggggttttcctcgtcccactggccgagttcgtcgcggacccgcttcagccagtcttccagcaccgggccgggccgggcgttgagcgccgggaacgagccgacgatgcccgccttgcactgggcgatcaccagatcggggttcgacacgatgaacagcggcgagccgatcaccggcaattgcaggcggcgtgcgaggctgtcgggcaggctcatctcgaagcgtctcccaggcggttcccccaagggcggccgtcgttcgatgcgggcgcccatgctgtcggttcaggtcgtttccgtcggtccggttagtccgttccatatcggaaccctgtattgacagagtgcgttccaaatcggaacctgtcaagcgcatcaaggccgacatcgtcggccccgatgcccccccgaagcccctgggagagcccgcccgatgcggtggaacgagttggacgaggagcattgctcgatcgcgcgcaccctctcgatcatcggcgatcgctggacgctgctgatcctgagggaatgcttcatgcgcgtgcgccggttcgagtatttccagaaccggctgggcatcacccgccatgtcctcgccgaccggctgcgcaagctggtcgaggcggggttgctggtgcgcgtgccctatcaggaacggccgctgcgcgaggaataccggctgacggaaaaggggctcgacatctatccggtgctgatgtcgatcctgagctggggcgatcgctggcgcaccgacagcgagggcgtgccggtgctgcaccgccatctggactgcggccaccacttccgtccggtggtctcgtgctcggaatgcggcgagccgctggatccgcgccgcgtctctcccgaacccggccccggcatcaccgacgaggcggcgctgcgctatttcaccttcggccgtcacggctcgtcaggtgccctgcaggcacatccgcagcccgcccccacagacgacgacggggcggtggactgaccaccgccccgtcgggcagacatgccggatgctatgacgtcagtcggatgctgtaacgtcagtgcggcctcaccggccgacggcgttcgcgcacccgcagcgggccgacccgggcctcgatcgcggccgcgacctcgcggcgcagaccgatcatgaaggcggtttccgagaccacgaagagcgggccgatcagcagcccggcgacatcgtccagaaaggcgggcttgcggccttcgaaaacatggcccaccgcctggaagatccagcccacgacgaacaggcccagcccccagcccagccagacgccggtgctgcgatcagccagcgcatcgccggtgaccacggccgccgtcaacagcacggtcatcaccgcgccgaagcgcagatccaggcccagataccaggccgcagccaggcccgccaccaccatggccggattgagatggacatcgcccagatccagcgtcggccgcgacaatagaatcgcgaccgcgaccacgatcatcggaatgccgatgagatgggtgatcagattgcgggcatcacggtgataggcgccatagccggccagccggtcgaccagccgttccagaccccgcggcgctgcgggctccacgctgtacattgcaactgcctcctccactgccgcctgcggttgtcccgccggtcgccattctttgagtgtcaaggatatgccgtccgggacgccgcgtcgccagaggaaatctccatgcagcatcacccgtcggacgccccctcgaagggggtatcgggaacccccgcacagcggtagtctgcgaccgatcgctctacccgttcgacaccgcgccgaggagacggcccgcatgcgcatcgccatctggaccccgaatgcccgcgacctgatcgccgaccgcgtcgccgcggccgggcacgagccggcggtggccctgaatggcgaggatttcgcccgcatcctggccgagggcgtcgacatggtggcgatgatctcgcaattctggtcgcccaaggtgcgcgatctggccgcggcggcgatgccgcggctgaaactggttcagctgctgacggccggtttcgacccgctggatgcccatggcgtgcccgccgggctgatggtcgccaatgccggcggctcgtattcgccgaccgtcgccgaacatgccgtcgccatgatgctcgccctgctccgccgcctgccccaggccggcatcgcccaggcgcatcagaactgggatcggggcatcctgcgcgagatgggttcgctcgaaggccgcaccgtcaccatgctcggtttcggctccatcggcgaagagacggcgaagcggctgaagcccttcggcgcccgcatcatcgcggtcacccgcagcgcccggccgcatgatctggccgacgaggccgtgcggatcgacgatctggcgacggttctgccccgcagcgacgtgctctatgcctgcctgccgctgggcgatgccacccgcgggctgatcgggcgccaggtgctggccgccctgccccgccatgcactggtgatcaatgtcgcccgcggcccggtgatcgaccagaccgccctgctcgaagccctgctctcgggctcgatcgcaggtgccggcatcgacgtcgccgaccccgagccgctgcccgcagatgcccccctctggcgcgcgcccaacctgatcatcaccccccatgtcgcgggcggcggatcgggcgccatcgacgagcgcctggccgccgtcaccatgaccaacctcgcccgccttcaggcgggcgaggtgatcctgcatccggtgcagccgcgggtcgagtgatgtcttcagtcgggcagacctgatcagctgccgaggcagatcatcgaccaagtcgaccccgtgaccttgtcagtacccaccatggtactggcatcaatctcgacggcgccgccgccagtaacccgcgtttcgagccagacctcttcaccagcggcaagacggtcactcacatccccgctgaccaccagcacaccatcggcattcgccacacggtcgtcgatcagaagccggatcccggcatcactcaggctgctgcccgacttgaccgcatgaacctccactcgctgaccggccgtaatcccggtcagcagcaggttggcagagatccggtagcagccagccaccacggcgacgaatttgccgccgaccatctgctcgcccgaaacgggcggactgggccggtcgaacaccttcacccatttttcgtcgtcatcatcatcactgatgttgaccagggatttccaggcgccatccgctggtacctgaatgttcaatttcagcatttcctcgccgccgatcgccgtctccagaacccgcacgtcggtgcccgcctgcaacagcaccttgttgttcacgatggtggtatccggggcgatctcgatcttaccgttgacataggtgatctggccggtgttctcgcggaagtgggcagcgggaccaaggcgcagcgtggtatgtgcggtcgatccgctcggcgcttcgccggtcacgaacagcgccgaagaggtcacgcgcccgccgatgtccacgacccgcgagccggcggcgacactgccgtagacgttcagccgcacgaaagctccggacagcacgctgaagcgggtggtgccaccatcggtgacgctttccaccgcaagaccggtgccgccttcgggcatcccgctcacggtgccgatgatggtgttgtagtagaagctgtcggcggtcgagccggccgcgcggcggaagcgcagaccccagccgcaatcggtcgcgcggatgccgatcaggatgttgctctcgttgaaaccgctgtcgacattgacgaagtcgaagccggtgccggcgggcagcgcgcgggtctcgacattctcgacccggctgtggcgggaattgcggaagaccagacccgaggcgccggtggtatcggtcagctggccgccgtcgatcgtcagccccgagataccggtgccgtcgacctggcccgacagcgtcacgccggcagccgtattcgcaagcgtcaggaccgaaagccccatgccgtcgccgatcaggcgcttgccttccagaacatgcatgtcggccaggctccagctgcccacggggacgcggaccacatcggccacctccagcgccgcggcaaggccggggctggcgctgccgtccgccgcacggatgaaccagggcaggtcggcgatcgccgaccagatccggatccagcgcccggtcccgcccgccgtcggctgaaagacggtgccacggttgggcgtcgccgtgctggcggcatcccactgaaacacaccaccgcccccgtcattcaccacattgcgccccagaatctgcgcgggcccccgccaacctgcaggaatcgccagaagatccgccagcgtatcgaccacgatcatgtcagccatgtcttcgctccatctttccggatgccgatccatccgaaatcacgcagcgagaatgccccgcgggttctatcgtcggcacgcgatcatctgttgcaacatgttgcagcgccgccgcgggatcctcatgaccaggatctgagcgaaaaacaggcaaaatgacgaggaatcgggcaagcgcataatttttatgcagtcattcccgatgccggccgcattttctgaccagttggtcagggtttccgccatcatgccatggcagggctgcacccgtgccatggcacggcttttgctaaccttccgcaccgccagcgcccccggggagacgggggtggtgacgcaatgcccccgcatgcgcacacggcgatgacgatccggacccggggcccagccggggccggtgagacgtcgccgcaaccgccaagcaaagacagggccggcgcgcgaagaacgatgccggacggtggtccccgcgttgtggaggcagtcatgccactcgagaacgttcccatcatcgatcttgcgggctattacgacggcacgcccgacggcaaggcgaaggtcgccgccgaggtcggccgcgcctgccgcgatatcggcttcatggtcgtcaccggccatcaggtgccggcggatctggtcgcctcgacctacgacatctcgcggcagttcttcgacctgcccgaaccggtgaagcgcaaggtcgcccagccctcgcccgatcaggtccgcggctatagcgggctctgcgaagaggggctgtcctacagcctggacgatcccaccccgcccgacctgaaagagagtttctcggtcggcccgatcgacgtgcccagggatgatccctatttcaccgagggatcggcggcggtgcatttcgcgcccaatctctggcccgatcaggatctgccggcgctgcgcccgatctgggaggcctatttcaagagccaggagacgctggccgccgatctgatgcggctgttcgcgctggcgctcgacctgcccgaggccttcttcgacgacaagatcgaccgtcatatcagcatgttccgggtgctgaactatcccgatcagaaagacgagccgctgcccggccagatgcgcgccggtgcccattccgactatggcagcctgacgatcgtgcgtcaggaagaccggccgggcgggctgcaggtgcgcaacaaaatgggcgaatgggtcgacgtgcccttcatccccggctccttcgtggtcaatatcggcgatctgatgatgcagtggaccaacgacacctggatttcgaccatgcaccgggtgatcaatccgccgcgcgacaaggcgctcgacagccggcgcatctcgctggtcttcttccaccagccgaattacgacgccatggtgtcgtgcctggaaagctgcgaagggcccggcaatccggcgaaatacgcgccggtctcgtccggcgatcatctctacatgaagttcaccaagcagaccgcccagggccgcgacgccgcctgagcggcggcgcccctcccgcattcgtcccgagttggagcgacgcccgatggcgcatctgagctatgtgaacgtcttcgcccgcgacgtggttgcgttgtcgggcttctattccgaggtcttcggcttccccgaaatcgaggcgatacgctcgccgattttccggggcatcgatgccggcggcaccgcgatcggcttcaacgccctcgacgcctatgaactgctcaaactgcaggattttgccgaaaccaaaggcgtcaaattcctgctcaacatcgatgtcgacacggtcgacgaggtcgatgccatggtcccgaaggccgtcgaaaagggtgccacgctgatcaaggcgccctatcgcacctattacgactggtatcaggcggtgctgctcgatcccgaaggcaatgtcttccggatcaacaagatgctcgactgaccggcagccccctctctcatccccctgacgctcccacgatcttttcctcttccacgatctttccgaggatccggacacatgcggatacgcgcagccctgacggcggcgatgatggcgctcggcctgatgtcggcggtgccggcgccggccgatgcggcgatgggcatcaagggcgaccccaaggttgccttcatctatatcgccccggtcggcgatctgggctggacctgggcccatgatcagtcgcgcaaggcggtcgaaaaggaactcggcgtccagaccgcctataccgagagcatccccgaggtcaccgagcgggtatcgcaggtgatcgaccgctatgtcgggcgcggtttcaacatcatcgtcggcaccgccttcggctattccgacgccttcaaggaagccgccgcgcgccatcccgaggtggtgttcatgaacgccgccggttacacctcggcgcccaacctcgcctcctattacggcaaatcctacgaatcgctctatctggccggcatggcggcgggctatgccaccaaatcgaacaagctgggcttcgtcgccgcctatccgctgggcctggtgctgtggaacgccaatgccttcgcgctgggcgcgcgatcggtcaaccccgccgccgaggtcgcggtctccttcaccaacacctggtatgacccggtgcgggaagaggccgccgccaaggcgctgatcgaacagggtgccgacgtcatcggccagcaccaggacacccccggaccgcagatcgcggccgaacgcgccggcgtgaagtcgatcggctacaacgccgacatgtcgtcctccgcccccaacgcccatatcatggccgccacctggaactggggcgccttcgtggtgccgcagatcaaaaaggcgatcgccggcaccttcgagggcggcaattatttcgaagggctggaaaccggcctggtcgacatctccgccttcaccggcacggcgctgaccgacgaccagaaggctaagatcctggagaccaaggccgccatcgccgagggcaggctcgacatctggaagggtccgatcaaggaccagaccggcaaggtcgtggtcgcagacggcgccaccctcgataccgcccagctcttcggcatggatttcctggtcgagggcacctcgggcacgctgccgaaatgaccgccgccctaccccgcgcgccatcaccccgcgcgcacccgatggtcgccgcctcccccgccgcacctgcggcgggggcagaggcgctgtcgctcagcggcatcgacaaggccttcgacggcaagccggcgctgaaagccgccggcttcaccgcccggttcggccagatccacgccctgctgggcgagaacggcgccggcaagtcgaccctgatgaccgtggcgacggggctctatgcgcccgaccggggccgcgtggcggtggcgggcgtgccggtgccgggcttcgatcccgacatcgccgccggcctgggcatcgccatggtccaccagcatttcaagctggtgaagccgttcacggtggccgaaaacctgcgcctcgcctgcgcgaaagcgttcaccggtctcacccgcgccgaaatcgcccgccggatcgcggaagcgggggcggaggccgggctcgacctcgatcccgaggcgcgggtcgccgacctctcggtcgccgagatgcagcgggtggagatcgtgaaggcgctgatcacccgcgcccggatcctgatcctggacgagccgaccgcggttctggccgatgtcgaggcggcggccctgctcgccacacttcgccgcctggccgacgagggccgggcgatcgtactgatcagccacaagctgcacgaaatcgccgcggtcgccgaccgggtgacggtgatgcgtgcgggcgaaaccgtcgccgccgacctgcccgccgacgggctgggcccggccgagcttgcccggctgatggtgggggagccgggccccgccgtcacacccgctccggcccggccgggccaggtccggctctatgtcaacgacctcgccggccggcgcgacgacggcgcgcccatgctgcatggcgtgcagctggctgtgcatggcggcgagatctacggccttgccggcgtcggtggcaatggccagaccgaactggccgaaacgatcgccggtctgcgccgcgccgatgccggccaggtggtgatcgacggccatgccttcgaccgccagccccctgccgcgcgccggcaggcggggctgcgcatcgtgccggccgaccgtttcgccgcggcccttgccgccgacctgccggtggcgctcaacctcgcgctcaccgggctccgccgcggccgtttcctgctcgaccgcaaggcgctggccgatcgtgcccgcaagctgatcgcggtccacggcattgccggcgccaccccctggaccacggcgcggctgctgtcgggcggcaatgcccagaaactggtcctggcccgcgaactgggcgatccggcaaccgcggtggtgctggcccattcgcccacccgcgggctcgacgtccgcgccgcccaggcggtgcgcgccagcctggtccgcgcccgcgatgccggtgccgccgtgctgctgatcagcgacgacctggacgagatcctggcgctggccgaccggatcggggtgatcaaccgtggccggatcgtcggcgaactgtcgggcggggccgatcgcaccgccatcggcgcgctgatggtcggcgatcagaaggggcacgcccatggctgacctgaccgttcccgccggccgccggccgcgcctgcccgtccggctgatcgccacgccccgccgcgatgtccggccccgccacaccctgctcgccctcgccgtcgggctgggggtggggcttggggcgaccgtcgccatgctcgccgccgccggcgtgccgccgcgtgacgtgctgaatgaattcgtgatctacaccttcttcagcagcgaaggcctggcgctgaccatggtggccgccaccccgctgatcgtggtcgggctcgccgccgccgcggccctgcgcatcggcttctggaacatcggcatcgagggccaggcctggatgggtgcgatctgcgcaacctgggtcgccgtcgccgatatcggcagcccgggcgcgcgcctgctgctgatggccctggccgccatggccggcggggcgctgatggccctgccgccgctgatcctgaagcgccggctgggcgtcaacgagatcatcaccaccctgctgctgaactatgtggccgccctgttcgtgcagcatctggtcttcggggtctggaaggatcccgcctccagcttcccctattccgaaagcttcgagcccggtgtcgagcgtctggccgggctcggctggggcaaggttcatgtcgggctgatcgtggcgctagcgcttgccgccctgctctggctggtggcggaacgctcgcgcatcggtgcctgggtggccgcggtcggggccgatgcccgggtcgccttcgcctgcggcctgccggtcgcgggcgtgatcgcgggcgccgtgctgctctcgggcgcgcttgccggcctcggcggcttcatgatcgccgccggccaggaataccgcctgacccaggcgctcgccaccggcaccggcttctcggcgatcgtgatcgccttcctcgcccgcttcggcgtcatcccggtggtgatcgtggcgatcctgactgccggtctctatgtcgcgggagataccgcccaggtcttctaccagctgccgcgggcggtggtgctgctgatccagggcgtgatcctggtctcggtggtctcggccgacatgctcgcccgctacggcatccgcctgcaccgtgtcggcccgcatcccgcaaggggggaccggccatgaccgacgccatcttcctgatcaactgggcggcggcggcgctgccgatgaccatgccgctgctgctggcggccctcggcacaatccttgccggccgggcgggtgtgctcaatctcggcaccgagggcatgatgatgtgcggcgcgcttgccggcgccgtcgcgtcgctcgccaccggcagcccggtcgccggcgtcgcggccgcgatcctggccggggccggcctcgccctggtcttcggcgtcgcctgcctgatcttcaaggccgatcaggtggtgaccggcctcaccctcgcagcactgggcgccggcatcaccgggctccttggccgcgattacgcccagaagagcgtgcccggcttcccacggctggaagatcacgccctcgcccatctgcccggcatcggccctgttctcttcgcccaggacgccctgctctatgcctgcctgccgctggcggccctggtctggtggtatctcgcccgcacagatggcgggctgaagctgcgggcggtgggcgaggcgccggatgccgccgatgcggctggtgtgccggtcaccgccacccgcatgggcgcggtgctggccggcggtgcgctttcgggccttgccggcggctatctggcactggccggcagccggatgtggatcgagggcatgaccaacggccgcggctggatcgcgatcgccgtggtcatcctggcgcgctggaacccggtcgcggcgatcggcggcgcgctgctcttcggcgcggtcgatgcgctggtgccccggttgcaggcggccggcgtggcggtgcccaccttcatcctgttcatggcgccctatctcgccgccctggcggtgctggtggccaccgccatcctgcgccgcgacggcgccatgggcccggccgccctcggccgcccctattcgcgagaggatcggcactgacaccccggaccgtcacgggctcttcccttgataccggcaccgccgcacccgatcttgcctgatcatatggcgagaacggagacgacccccgtgccctatcccaagaccaccggccgggcgaccggcagccgcccgctggagctggcgccggccgcgccgctccagccattccgcgaccccaaggcggcggtggaccggctggtcgaactgttcgagcgcaacacccgctggctgcgcgatgccttcgcccgactgctcgacggcagcctgggcgaggtgcgggtgcgtgccttctaccctcagatccgcctggttaccgacagccataccagggtcgacagccggctctcttacggcttcgtttcggggccgggggtgcatgccaccaccgtcacccgccccgacctgttccgccgctatctcaccgagcagatctcactgctgatccgcaatcacgacgtgccggtgctgatcggcgattccgaggtgccgatcccgctgcatttcgccttctgggacggcacccatgtcgaaggcgccgcggcgctgcgcatcgaccggccgctggccgacatcttcgacctgcccgatctgaagctgatggacgatgccatcgccaacggcacctatgaagcgcccgacggcgtactgccgctggccccgtttaccgccccccggatcgattattccctgcaccgcctgcagcactattccgccaccgctgccgagcatttccagaatttcatcgtcttcaccaactaccagttctatgtcgatgaattctgccgcatggcctcggagcttctggccgacggcgacagcggctacgaaagcttcgtggcccccggcaacctgatcacccgtgcgggcgaaaccggtcgcggcctggcactgcccgacggcaagctaccgcagatgccggcctatcacctcacccgcgccgaccagtcgggcatcaccctggtcaatatcggcgtcggcccctccaacgccaaaaccatcaccgaccatgtggcggtgctgcgcccccatgcctggctgatgctgggccactgcgccggcctcaggaacagccagcgtctgggcgattacgtgctcgcccatggctatgtccgcgacgatcacgttctggatcacgacctgccggtctgggtgccgatcccgccgctcgccgaggtccaggtggcgctggaacatgcggtggccgatgtcaccggtctcgacggctatgatctgaagcaggtgatgcgcaccggcaccgtcgcctcgatcgacaaccgcaactgggaactctggaaccagagtgccctggtccagcgcttctcgcagtcgcgcgccatcgcgctcgacatggaatcggccaccatcgccgccaacggcttccgcttccgcgtgccctacggcaccctgctctgcgtttcggacaagccgctccatggcgagctgaagctgccgggcatggccaccgatttctacaagcgccaggtcgcccagcatctggaaatcggcatccgcgccatggaggcgctgcgcgccatgccacgcgaacgtctgcattcccgcaagctgcgcagcttcaccgaaaccgcatttcaatagggcaccagatcggggtctcgcgggttgtacctccgggcatgcatcgacatatgagaggtgcgcccccgaacaggaggaccctatgaccaaccggaaatcccccgccgacgaggttgacgagaccgccgcccgggcccataccgacgagcgcctggacgaggcgcttgaggagagcttccccgccagcgacccgccgtcccagaccgagcccggcaacgcccgcatcgacgacgatcccgccgaagatgcggagaccgaagccgaagagcacgaggaggaacgggtcgacgaagccctggaagagaccttcccggccagcgacccgccctcgcattcggaccccaattccggtgtgacccgcaaccgcaaaccggccccgccgccggacccggcccgctgaccccacccgccccaccccggcggggaccaccatgccgccccctcggcggcgggtccccgcccttttggaggactgaagctgtttgacttttaatcacgcacaggttggtatgcacagctgattttgacgctttcgggtcatctcccatgtcgggaggcagcaccatgtcgggaggcagcatcgcccccatgaacgaccttcttgagattgacggcgagacggtgatcgtcaccttcgatcccgagattcggatgctgcgcggtgcattcatcggcctgagcggtggcgccgacttctatgcgacgacgatccccgacctgatagaggaaggccgcagatcgctggccgtctatctctgcctctgccgggagaggggcattgaaccgcgccccaaagtcgcatgactggcggtcccccatatcgggcggtagcatggcaggcatcccgtccacctggcccaaggatgcgcgcccatggcctccccgccgctccgccccgagattgccggccgtgacggccggccgctgccggttctggtcgacctgcccgagggcggggcggtcacggccggctgggcgattttcgcccattgcttcacctgctccgccgccagcaccgcggccacccgcatcgcgcgggggctggcggcggaaggcttcggcgtgcttcgggtggatttcaccggcagcggtgaaggctgcgagccgccggcgcccgatttcgccgccgatgtcgaagacatcatcctggccgccggctggctggagcggagccatgcagcgcccgtcctgctgatcggtcacagcctgggcggcaccgccgtgctggcggcggccccaaggctcgccgccgtgcgcgccgtcgccaccatcggcgcgccctccgcccccgaacacatcctgcaccatctgggtcgcgccgccgatgacgcgctcgaagacggccgcgccgtgctgccgctggggtcgggcaccatcaccgtcacccgcgatttcgtccagggcgtgcgcgaggccgaggtgctgcacggcctcggccggctgcacaaggcgctgctggtgatgcatgcgccgctcgaccagatcgtcggcatcgacgaggcgacccggatcttcgtcgccgcccgccatcccaaaagcttcgtgtcgctcgacaccgccgaccatctgctgaacggcgccgccgatgccgcatatgccgccggcgtcatcgccgcctgggccgcgcgctatacccgcgacgacgacggccatcgccacggcgcccgggccggcgcgcccgatgccgcggcggtcgatgccgccaccgcggccggcgcgccgccgcccgaaggccgggtggtggtggcggagaacggccggggcagactcggcaacacggtccgggtcggccggcatatccaactcgccgacgagccggtggcggtcggcggccaggatggcggcccggcaccctacgactatctgctggccggacttggcgcctgcacctcgatgaccatccgcatgtatgccgatcgcaagggctggccgctcgcccgtgtgaccgtcacccttgcgcatgccaaggtccatgcccgagactgcgccgagtgcgaaacccgcgagggcaagatcgacgtgatcgaccgggagatccttctcgacggtccgctcgacgacgaccagcgcgcaaagctgatggagattgccgacaaatgcccggttcatcggacgctgcattcagagatactggttcggacgcgcgcggtgacggcgtgatccccgacgccttcgccgatgccggcttcacggtcgagcgtctggtgatggatgacggcgtcgccctcaccctcgcccggatcggcccgcgttacgccgaaagcggccgccggccggtgatcctgggccatggcgtcggctttgccaccctcgcctatcgcggcctctggcagaccctgtcgcgggatcgcgaagtcgtggcggtggacctgcgcggccacggcctcaacgccgccggcatcgacgcgaccccgccccaggcccggcttgccgccgatcaggccgccatcgcccgccatcttgcggccgagaccggcacgcccccggacgcggtgttccattcctattccggcgtgctgtcgctgcatgccgagcaggccgaaggccggctctatcaccgtcgggtgttcatggagccgccgctgatcccggccggcgagatggagggggcgacagaggccgccgccgggcgcgatttcatggccgagcggatgaagcgccgccgtgaccgtttcgccagccttgaggatttcgcccgcatcttccgcgagcggccggaattcgcctggatggagccgggcgcccccgacgatctggccgccgccgtgctggtgccggccgaagagggcggcttccgcctcgcctgcgcccccgccgtcgaaagcggcttctacagcggcaacacgcccgaagggctctgggatctgctcgcccgggcgaagcgcgcgccggggctggtcgcccccagcctgatgatcgccggccgccgccccaccggcatcaccgccgatcctttcaccgccgccatcaccccggtagccgcccgcgccggcggtttcgacctgcttcagctggccgacatcacccatatgctgccgatggaacgctccgccttcatcgccgcggcagccaccgcctttttcgacgaaccggcgcgggaggaaagcgccacctgacagtcatgagatgaccgtttaaagaatctcactgacagatattgaaatctgtcatcgcaaagcgcatcctctcttcacaccccgatgaagagaggatggtgtcatgcccgtatccgttcccgcccagaccttcaccggcaccgccggccggctcgacgacccgatgaccctgccggcgctcggcctcggctgcatgggcatgtccgatgcctatggcccggccgatcgcgacgaaagcatcgcgaccgttcatgccgccctcgatgccggcatcttcctgctcgataccggcgatttctacggccagggccacaatgaactgctgatccgcgaagcgctgtggagccggcggcgcgaggatgtgttcattgcggtcaaattcggggcgctgcgcgaccccgagggccgtttcctgggcttcgacagccgcccggccgcggtcaagaacgcgctcgcctacaccctgaaacggctcggtaccgattatgtcgacctctaccagccggcccggttggatcccgccgtgccgatcgaggacacggtcggcgccgtcgccgagatgatccaggccggctatgtccgccatctgggcctctcggaagtcagcgcccagacgctggagcgcgccgccgcggtgcatccggtgcgctggctgcagatcgaatattcggtgctcgaccggggcatcgaagcctcgatcctgcccgccgcccgccggctcggcacggtgatcagcgcctatggcgtgctcggccggggcctgctttcgaccgattgggcggcacgcaaggcgctggcggtgggcgactatcgcgcccatctgccgcgtttctcgggcgacaatctggaacgcaatctggcgctcaccggcgtgctgcacgacatcgcggccgaatacgagatgaccgccacccagatcgccatcgcctgggtgctggcccagggcccggatatcgtgccgctgatcggtgcccgccggcgtcaccagttggccgaagcgatcggggcgctcgacatccggctctcatccggcgatcttgcccggatccgcaatgccatcccggccgatgccccggccgggacgcgctacgcgcccgagcagatgcggatgctggatagcgagaccggggccgtctgacgccccggccccccggggagagatggattggccgacggcgcgctcacgcccgaacagattctggacacggcggaggatgtcctccgccggttcgggcttcagaaaaccactgtcgtcgacgtggcccgtgcgcttggcgtcagccatggcagcatctaccgccatttccccagcaagaccgccctgcgcgaggcggtggccagccgctggctcgcccgggtctcggaaccgctgggcgagattgccgccgaaaccggcccggccctgccgcgcctgcgccgctggctggagcagctgatcaggatcaagcgcggcaaggtgctcgacgatcccgagctgttcgcggtctatcacgcgctggcagacgaggccgatgccgtggttcaggagcatgtcggcaagctggtcgaccagatctcgcgcatgttgagcgacggcatggtcacgggcgaggtgcggttcagcgacccgcgcgccatggcctgggcggtgctgcgcaccaccatggtcttccatcaccccgcccatgtcggccactggtcgctgcccgaagccgatgtcgaccgcgccttcgacgacatcttcgatctgatcacccgcggcctgaccccgaccgaggcgtgaatctccgcccctatttgcgaatcactatcaatctcataacatgatctgctagtctgacggcactccgccactgccggatccgccgccgatgaccgaccgccccgcttcgcttcaccccgccgagaccgagttccgtgccggcaaggaattccgtgtggggccgcgcctgctcgaccggctgtcggccggccgccccgactggcaggatcacgcccttggcgtcggccgcggcgcggtgcgtttccggacggcgcgccccggccccggcctgacgctcacgaccagttcctgccggctggaggcagactaccgctcgcacatcgatcatggtggtgcggtcggtgtgctcgccttcgggctctcgggcaccagcctgttcggctgcggccgccccgatctcacccacaaggttcaggccggtgatgtctggctgttccggctggacgatgcgccgatcacccgtctcaccccggcccaggaccaggcctcgatgttcgcggtcaagttcgacctcgaccgcatcgccacggcactggccgaggcggggatcgcgcgccagggcaccggggcgcggcgcctggggcggctggatgatcgcagccccctttccgccctcaccggcaatccgctggcctctgccctcgatcggctccgggccgagagtgccgccctcggcctgcttgccgactggctcggcccaggccacgccccggagccgccaaatggcctgctcgcgcccgaagaccgccgcgcggtcgcccgggttgccgaccgcctgctggccgacatggccgaaccgccctcgctcgacgagttggcggcgctcgccggcatgagccatgtccgcctcaaccgctgcttccgcaaggcctatggcgccacggtcttcgcctggctgcgcgaccgccggctggatcaggcccgccgcgcgctggaacggggcgaggcgagcgtcaccgaaatcgcctttctctgcggcttcagcagctccagccattttgctgccgccttccgcgcccgccacggcaccagcccggcggcgttccggcgcggataggcccccgccctttcgccagatgacggcacgccgccgccggaccgggcatggtcatccacagaccgcccatccggagcccgctgcccccatgtccacccgtcccgcgatcgccgccctgcttgccgccctcaccgccaacggcgccggccatgcctttctgctgatcaccctgccgccgcttggccgcgcccgcggtttcggcgatgtcgaaaccgggctgctgctcggcctctccgccctgctgatggtggtggcgggccccgtctgggggcatgtcgccgaccggatcgggcgccggccggtgctggtggcggggcttgccgccgcggcgctcttccccgccctgctcgccgcggttctcgacgccctcgatgccggccggctcgatgccggccgcgcctatatcctgctgctcgcggcccggctggttcaggccgccctgtcggccgggatcatgcccgcagcccaggggttcctggccgatgtcaccgcccgcgaccgacgcgcaggcggcatggggatgatgggcgccgccttcgggttgggctcgatcctgggcggcatgaccgcctggcggctgggcggcgcctcgccggtcgcggcactgctgatcctctgccttgccatcgccgccggcacgcttctggttgcgctgctgctgcgggcggcgccgcgtccggcacctgcccttgcaaccgcacccgccgcgccgcgcccgccgctcggggggcttctgccctttcttgccgtcaccttcgccgggctcgccgcctatgcccagcttcagcaggtgacggcgcttcgcctccaggatcagttcggcctgggcgctgccgcctcgatcgagcgcggcggcgcgctcctcgccctcaccaccctcgccatggtcgcaacccaaggcctggtgatcggccgtctggcctgggcacccggccgtctggtgcagacgggtgcgctgctcggcctcttggccatgacggctgccgccgccgcccccaccatcctctggctgcagctcgccatggtgctgctcggcgccggtttcggcctgctgctgcccggcaacctcgccgggctcagcctcgcgacccctgcgggcggccaggcccgcgccgccggcatcaacggcatggcccagggcctcgccatggcggcggggccgatgctcggcgccacgctgcaccagctctcccccaccgccccctggtgggcgggcgcggccctgctcgcggccattgcaggcctcgccttccgccgccgcaccgaagctttcgccggatgacggcgggcgttcgccataagggcgcccgcggcgctctcgggcgctagcctcgccccatctcatccagcgccttccggagacgcccatgaccacgcatcgcagggtccgcacccgcctgctcgcctccgccgtccccatgctgctggccggcggcacgacgctcgtcacgggggcggcccgggccgacgaggacgagaccatcacccgcctcgcccccgtgatggtcgaggcacgccagtggaccgaggatgtccgccgcacccccggcaccgtcgagctgctgacacccgaggatcaggcgggccccctcgccgacggcctcgccggcatcgcccgccgctcgcccaatgtgctgatcgaacagtcctcggtgcagacgcgggtggtgatgcgcggcatgaccgtcgccaacaccgccctgcaggatccgctcggcttcacggtcaacgacgtggccctgccccatggcgcggtgcaggcgccgcgcctgcccgatcccggcaccatggagatcctgaaaggcccccagggcagtctgtacggccgcaacaccgaggccgggctgatccgcaccggcaccgccgatcccgactggcagccggcggccgaagcccgcgccattctgggcttcgaagacggcgccgacggctggagcccggcctggacgatcagcggccgggtctcgggcgccatcgcgcccgacaaggcggcggcgtcgctcgcgcttcgggcagaacaggcccgcggccccggcctcaacctcgccgacggcgccgatgacggcgcctcaaccgaccggctgaccgtttcgggcgggctgaccctgctgcccgacgacgacaccgacatctcgctcaaaagcgtcgtggagcgggccgatctcggcaagcagcggctgcgcttcctgaccggcccctatgccacgccgcgccacgtcaccaattacgacgccgcctcgtgggacgacacggtgaccgccatccagtcgctgcgcatcgaccatcgcgccgggccggtcgacgtcaccgccatcaccggctggacgcattacacccgcgatttccggatggatctggacggcacgccgctccccaccctgccgactctctcctcccacaaggacgacaccgtctcgcaggaactgcgcatcgcctcgcccgacgacggcgcgcggctgcgctggctcgccgggctttacggctatgtcagccgcaccgatctcgatttccgcatcggcacgccgcgggtggcacgcgagacctcgatcgaccagaccggcatcgccggcttcggtcaggcggaatacggcctgacacaggatctgcgcgtcaccctgggcgcgcgggtggagcggatcgaccagagcggccggatgcggctgaccaacagcgccggcagctccaccttcgacgccgacatcaccgataccacgcttctgccgaagatctcgctcgcctgggatgtggcgcccgagacgatgctgcatgcgtcctacgcccgcggctatctgccgggcggctacaattacggcaacgccaccgggtccgacagcctgacctatggcgccgaacacagctggacggccgaggcgggggtcaagaccgccctcttcgccggccgggttctggccgatctcaccctcttccacaccacctcgaccgatcgccagatcctcgatctggaaccgggtggcgtcaccaccatcagcaatgccgcagaggcccgcatctacggcgccgaactcgccctcgacggccggatcgacgaggtctggggctggttcgccaccggcggcctccagaaggccgaggccacctcgtatcgcaccaccgtcaaccgcggcggcacgctggtcccggtcgactattccggcaaccgcctgccgatggcggcagaggccacctggtcggccgggctccgctacgaccagggcggccccgccggcggcgacggctggttcggcctgatcgccgccaacggctccggcccctattacttcgacggcgccaacagcctgtcgcaggacgccttcgccctggccgatgccgccctcggctaccgtttcggcaccatcgagatctcgcttcaggccagcaacatcttcgaccgcaatgtctatgcccgcgccgtcggcgtgccgctcggccagctggtcgaagacggcaccggccgcgaggtcagccttcaggtaaaggccagctggtgatgcgcaatcgcacgctccccgtcgtcgagacccccggccgcgacggcctcgccggccggctgttcgacctgatccaagcgccgctgcgctggcagctgcttgcggcggggctcgatctcggcctcttcgatcggctcgacccgccggccaccgcagcggatctcgcaggctccctcggcctggatgccacccgtctcggccgcgtgctcgacgcgctcgccgccatgagcctgctcgacaaaacccgcggccgctacggcctgacggcagaggccgcgccgctgctcagggccgatggcacgcggtcgatgcgcgacctgctgctcaccctgccgcggctccgccatggcgacgtcgccggtctgcttaaggatccgggcccggcgcccgcccccgatatggcggcacccgccttctgggacggctcggccaacagcctcagggccttccaccgggcgatgggggccgagaccgcccgccatctgctcagcctcctgcccgaatggccggcggcgcgccgcctgctcgatctgggggccgggtccgaggtgctggcctgccgcctggccgaccggcacccgcagctcgacatcaccgtcttcgacctgccgccgatggcagaccgcatccgcgcccggctgaacggccgcccggtcaccgtcatcgccggcgacatgaacgagaccgatttcggcaccggctacgacatgatctggacggcgatgacgctctactatgcccgtgatctggcgggcgtgctggcccgcatcaggggggctctcgcccccggcggggtcttcgtcaccctgcacgaggcgctgaccggcgaacgcaccgcccccgaaacccatgtcaccggccgcctcgtcccggcgctccgcggccaggaccgctccttcgacgacggcaccatcgccgccgccatgaccgaggccggattcacccggatcgacagccggctggtcgagaccgccttcggtccgttcaggatggattgcgggcgggggtgatgcccgtctgccccccacccgccccctcaccccgccgcaaacagccgcgtgcccacgaaatccacgaacaccctgaccttgggcgacagatggcggcttgacggccagagcaggtggaactggccgggcaggtccagatgcccggtcagcaccggcaccagccggccttcggcgatcggggcggcggccaggaaatcgggcatgcagccgatgcccaggccgccggtcaccgcccctttcagcgcctccatgttgttgcagaccatcaccgtccgcggccgcggctccgccgcccccgcgggcagtctcagcggccagggctgcaaccggccgctgttcggaaaacggaagcgcaccgcccggtggccgtccaggtcgcgcgggcattcgggctgccctgccgccgccagataggcgggtgccgcgcacagcagcaactgaaaggggcgcagcgcccgggtcatcaggcgggaatccggcagctcgccgctgcggatcgccacgtcgacgccctcgtcgatcaggtcaaccagccggtcgttgaaatccagctccagctcgatctccggatgggcggccacgaaatccggcagcaccggcatcagcagatgataggtcacgatcggcaggctgaccttcagccggccgcgcggcacctcccgcgaccgcgacagaaccgcccgtgcatcgtccagatcatccaggatccgccggcagcgctcgtgaaagacccgtccctcgtcggtcagggcgagcgcgcgggtcgaccgggccagcagccgcacccccatctcctgctccagccgcgtcaccgccttgcccacggcagaggccgacagccccagcacccggccggcggcggcgaaactgcccagatcggcggtgcgcacgaaagccgtcaggctgcccaaccggtccatggcatcaacccttcaattccggaattttcgtccagtctggacggaaaccaggcccgcttccagcatcaaccgatccggatcatcctgcctcttccctcgctcaccttcttccacgcatgggatccgacaggaatgagccgtatgatcaacccgccgggccgccatcccggggcagcccttctcgccgtctgtcttgcggcggcggctatgccgctcaccttcaccggcacggcagtggcgctgccggcgatcgcccgcgatctcggcggctcgccggtcgccctcgcctgggtgaccaatgccttcatgctcaccttcggcgcctgtctgatggcggccggtgcgctcgccgatgcccatggccgccggcgcgtatttcttgccggcaccggcggtttcgccctcgcctcgctggcggccgggctcgctcccgacatcctcaccctcgatctcgcccgcgccgcccaggggctggcggcggccgccgccttctcgggcggcatggcggccctcgcccagacggtcgaggggcccgcgcggctcagggccttcagcctggtcggcaccgccttcggcgtcggtctcgccttcggccccatcgcctcgggtacgattatcgatgccgcgggctggcggatgatcttcgcgctggtggcggcactcggcctcgccgcctgtctcgccggcgcccgggcgcttaccgaaagccgtgatcccgccgccaccgggctcgatcgggcgggggcggtcgtcttcaccctcaccctcacgcttctgaccttcgcaaccctccgggcgccggaaaccggctggagcgatccgctggtgatcctgctgctggccggcacgctggcgggcatctggggcttcatccgcatcgaagcccggcaggcgcgaccaatgctcgatctgtcgctgttccgcaacccgcgctttgccggcgtgcagctgctcgccgccgccccggcctatggcttcgtggtgctgctggtgctgctgccggtgcgcttcgtcggcctcgacggcatgaccgcgacagaagccggccggatgatgatcgcgctgtcggcgccgctgctggtggtgccgctgctcgccggccgggcggcgcggtggatctctcccgcccggctctgcggcggcgggctggtgatcaacgctgccggcctcgcctgggccgccctcctgccggccgatgccccgcccgcggccctgatcggcccgctgctcaccatcggtatcggcatcggcctgccctgggggctgatggacgggctcgcggtcagcgtggtcgccagcgaccgggccggcatggcgaccggcatcttctcgaccatccgggtggcgggcgaaggcatcgcgctcgccgtggtcggcgccctgctctcgggcctcacccttgcacagctggcgggcgccgggccgatggatgccacccgcctcgccgcccgccggctggtggcgggcgacgccgccgccgccctcgcagccctgcccgggcagagccacgcggccctgctcgcgcatttcgatgccgccttcgacctgctgctgctgatcctggccgcggtcacgctcgcaaccgcccttgtggtcttcgtgatgctgggccgcagccgcgaccgcgccgccgcctgcgcctgaccaggatctggagctgaccggagccggatcagtaccgcccggcgccctcgggcgtctccgtcccgatcctcgccagccgcgccgcccagccgtccagcgccgccatccgctccgcctccgtcagccgggccggctgccagaccacttccgaagcgagcacgtcgaagccgacgaattccagaataccgcggcggatcggccggagcacgccgtcgagatcgccatgcagcccctcgggcgtatagccggccggcgccccgcccgtggtcagcgacagcagcgcccgccggccgcggaaccggccggcctcgtacattcgcccgtcgccatagatccggcccatggcgaagctgcgatccacccagcccttgagcatcgccggcaggccgaaccaccagagcggaaactgcaggatcagcagatccgccgcctccagccgggcgatctggcgctccagatcgggcgcgaagccgcctgcaccggtggcttgcatctcttccgcctgaagtttcagataggtggggtcggccgtggtggtgaaattccgccggtccgagaccggatcgaagccttcggcatgcagatcggccagatcgaccgtatggccggcctgggtcagcgcggcggcggcctgccgcgccatggccgcgttgaagctctgcggttcgggatgggagaggacgatgagggcatgcatggggagcggtctccggttgcggcagtttgccggcggctggcccgccggtccttcaaggtgtagaaccggagaaagatgaaccccaccgaaatggcttcatgaccgatttcgatcctgttcaactccgcagactggatccgaccctgctgctggtgctcgacgaagcgctgaagcaccgccggctgacccttgtggccgagcggctgggcctcaccccctcggccatcagccatgcgctggggcggctgcgcgacatctatggcgacccgctcttcctgcgccgcgcgggcgggatcgagcccacccccgtggccctggccctggccggcccggtgcgcgccgcgctggaagcgcttgccgccaccatcggcacggcacgcggcttcgacccccggaccgcgcagcgggtgttccgggtggccgccttcgacaacacggtgtcggtgatcggcccgcggctggtcgcggggctcgccgccgaggcgccgggcctcggcctcgccttcctcagcttcggccgcgcccgggcggtccgcgccctgctggagggcgaggtggatctgatgatcgggctggccagccacgatcccggccggctgatctgccgggtattgttccacgaaggctatgtgctggccgcgcgccacggccatccggccttcgccgacggcccgcccgacctcgccacctataccgccctcgcccatatcctggtctcggccgcaggcgacctcgccggcaccatcgacgaggagctggcggagcgcggcctgtcgcgccgggtggtggcggccgtgccgcatttcatgggcgcgcttgccgtcgtcgccgacagcgatctggtcgccaccctgcccgagcgcgtggcccgccgccatgccgcgcggttcggcgtggcgctctgcccgccgccgctgccgctggcgggctatgacctcggcatcatgcgccgggccgcgtccgcgcccgatccgggcctcgactggctcgaagcccggatcgatgccgcgatcagttccgcgccggatccatctcctggcccggatcgttgaggccgatcaccgcctgacggtccagatgctccaccagcggcgccggcagtttcagcccatgggccagcgcgtccagccagacccgttcggccggatggtcgacatccaccgccagccgcgccgccagccagatctcggccgaccgggcctcgtcggtgccggcggcggcgatgtcggggatcgagaccggcgcatcgagcacctggaagatcgccgccttggtctcggggtcgaaatcgcggcgctccacctctgcgaagatccggccgcgctcgtcggcatcgatatggccgtcggccttggccgcgccgatcatcgccttcagcaccgccatcgcgaagccttcggcctcggccgggtcggtgatcgtgtcgagcggccggaaagcgggctctgccgccgccgcatcatcgggccgggccggcaccgcggcttcgggcgccttgcccgaccgccagtcggcccaggcccgataggccagcgcacccaacaccgcggcgccgccatagccgagcgcaccgccgccgaacttcttcatggtcttgcgggccttcttgctgccgaacaagagccccaccagcccgccggtcacggcgccgccgccgaacccgcccatcatcgacccgagtccaccggcaccggcaccgccgccacccctggcaccgccggtcaccttgcccagcatgtcgcccagccccgaaggaagccccccggaggaacggcccgagggcagcctgccgccctgcgcgctgcgggacgacgccgcccccatcacctggtcgagcagctttctggcatccatggtcgtgtctccctgcgaacagatccggcaccggccgtgtggtcttcggcacatggcccgcctgaagacacggttcaaggcgtggatctcctatggcatggcaaggacacggggcgcgagcggcggcggaaaacggtgccccctggatccgggggcacgccgctcccatctggtcaggacaccgtccccgaaggagagttcgagatgagcctgctcgacggcatcctcggccgcaatcgcggtccctccgccggccccttcccggagccaccgcccgcctccccgctcgaagccggcaccaccgaacaggagatcatcctggccggcggctgcttctggtgtgtggaagcggtctatcgcgagctggccggggtggtcgaggtcacctcgggctatagcggcggcacggccgacaccgccaattaccccgcggtctgcggcggtgacaccgatcatgccgaggcggtgcggatccgctatgatccgcgggtgatcgatctgggacagatcctgaagatcttcttctcggtcgcccacgacccgacccaggtgaaccgccagggcaacgatgtcggccgccagtaccgctcggcgatcttctatgccgatgacggccagaaagcggtggcagaggcctatatcaaggcgatcgacgaggccggggtcttcgaccgcccggtcgccaccgaactcgtccccctcgacctcttccacgaggccgaggcctatcaccaggactatgcggcacggaaccccaaccagccctatatcgcccatgtctcggcgcccaaggtggccaagctcaaagcggtctatccggaaaagctgaaaccgcgcggctgacggcggccgtcaccgccgcggtggtgacggttctgtccttacggtctcgccttcattctcgtcttcgtccgtctcttcgccggcaacccggctcgccagcagctcgcccgcacggttcagcaccggataggcggcggcggcgacgatctgggaattgatcagcttgatgtcgcgcaacaggtccagatgctgcgcactggtcagcgccgtctcgggccggccgctgcgcaggcggcggaaatgggccagcgtcgcctcggtctccagccgccggaacaccgccttttccgccgccagcagccgggcggcgcgcaggtcgcgggtcatcagcagggccgccgcctgggccagattgtcgcgcagccggtcgagcaggcgcagcagctccccctgtccctctttcgacagccgcaccccgcgcttgtggcatttgccgagcgtcggcagcagcccgcgatcgacggcatcccccgcctgttccagccttgtggcgaaggccagaagatcggtcagccggcgctcgtcggccgggcccagccgcgcgggctcgatgccggcgagataggtcttgagcgcgcggttgacgtggtcgagcacatcgtccaaccctttcagcgccgcgatcggccccggctcgccgctgcgcagcgccgcgcgcgcaccggccagcatgtcgtccagcacatcggccatgcgcagcacctcgcgcgtggcgagccccagcgcgacttccggcgtctcccgcgcctcttcgtccagatacagcgtgcgggccggatcggccggcaccgcccgcaccggcagcagccgggcgagcagcccggcataatggcgcagcaccggcaggaacaccgccgcgaccgtcagattgaacagggtgtggaagaccgcgaccatcctcaccgggtcttcgaccagccgccccatcgcgcccgccaccggctcgatcaggatcagtgccgccaccacgccgataacccggttgatcaaattgccgagcggcagccgccgcgcctgcgggtcgtcgccgcccgccccctccagcaccggattgatcgcggtgcccagattggcgcccagcaccagggcgatcgccatcggccccgccaccaggccctggcccgccatcgacatcaccagcagcaccaccgccacgctggaatgcgccatccaggtcagtgcggcggccagcatcaccgccgccaccggtgccgcctgcagcaggccgatcagggtccgcaccgcctggctgtcggccagcggcgccaggctgccgctcagatggtccagcgccagcagcatcagccccagcccgatcgccacccgccccagatcgtgcagccggccgcgttccagccgccggaacaccaccacaccgatcagcaccagcagcggtgccgccagctgcacatcgaaggccagaagctgcacgatcagcgtggtgccgacattcgcccccagcatcaccgccagcgccggcaccagggccagcaggccggtcgccgcgaaaccggtcaccatcagcccggtggcggtgctgctctgcagcagggcggtcacgccgatcccggcggcgaaggcgctcaaccggccgcggagggcatgccccaaccacagcttcagccgggcgcccgccgcccgctgcacccccgtctgcaccatatgcgtcccccacagcagcagggcgacgaaaccggcgaaatcgatgagggtggcggtcatgacgggacgggcttccgggggctgatctgaaggccgcggtatgcggcccgagggatcaaccggcggggtcgtctcccggttcccccatgccgtccgcatcgagtgccgcctgatccggggcatccacgacatccggatcgcccggcgcatgcgcggcctgccaggcctccaggaaaaccgcccagtgctggtcgaactgctccagccaggccgccagggtggtggcatcggcctcgcgcccgtccgcccgccagcgacgcaggcagagttcgttgaaggcgcggatatagtcgcgcaccggtgccagatcctcgcggccgatccctgccacctgcatggcatagatcaccgcgcgcagccccagaaaaccgccggcggtcggcaccatgcccgacatgcccgatgccagccagtccagctgcaggctttccacctcgtcgatgctcatatcggcgaagacggtcagcaggcccagcgccacctcttccgcctcctgctcgtcgggggcgatcagctggcgcacttcgtactggtcgaaaggattgtccggcagatcgtcacgcagctcccacacctcgaccgccagcggggtcaggggacagggcagcagcatgcgtggactgccttccatggggctcggcaactccgttgcggtggttgtcggtgcagagttccatgaagcccggccatgcacaatgcttcagatcaaagcgcgcaacctccggcatgatccgcgggcgccagtcacgaggggtcagggcgacaagaaccaccatcggcaggcagccgagaaccggcgccgcggtcgcgaatgccccgccggccgccatcgcctgccacagcccggccggcgtccacctcttcgaccaccgcggcccgtcgtccacgccgccgtcgtccacgccgctggcatccaccccccgggcatccggaccggccgtcttcggcgcccgcactgcgtcctcaagccgcatggcgcctctcctccttcatgatgttcgccgcccatgccgcaccggtatccaccggttcccttgccacatcacgatccaggatcagttcgacattccagccattccgccgtgcaaattcgactgccgaagcgggattggggaagcggaggctgatctgtgcccgggtgtcggcgctgccggtccagccggtcagcggatcgatccatggggcgctttcgggttcgaattccaggatccagtcccggctgcgaggcgcgcttcgggtcaccggccgtgcgggccgccagatcctgaccgtcggtgcagacgcacgggacatgcagcatgccgtcatggctcaccacctcctcatgcatgagacgcgccagcgcattccactccgacatcggatgtcagccacggcgccgggcgtctgccacaggcgcccggccatctgggatggcactccctttccgtcaacccccataggatcccctgccgccagacatgcaaaaccgcccggcgggtctccccgccgggcggttccggatcagcccggacacggcgctcgggatcagacgatctcgaacagacccgcgccgcccatgccgccgccgatgcacatggtcaccaccacatacttcacgccgcggcgcttgccttcgatcatcgcatggccggccagccgcgcgcccgacatgccataggggtggccgaccgagatcgcgccgccgtcgacattcagcttcgcggggtcgatgcccagcttgtcgcggcaatagagcacctgcaccgcgaaggcctcgttcagctcccagaggccgatatcgtcgatcttcaggccgttccgctccagaaggcgcgggatcgcgaagaccggaccgatgcccatctcatcgggctcgcagccggcgacctggaagccgcggaagatgcccagcggctgcaggcccttctgctcggccagcttggcattcatcagcacatgggccgaggcgccgtccgacagctggctggcattgccggcggtgacggtcttgccctcgccgcgcacgggcttcagcgacgacaggccttccagcgtggtctcgccgcgcatgccctcgtcacggtccagggtcacttcgcgcttcgaaatctcgccggtctgcttgtcggccaccagcatcgtggtggtcatcggcacgatctcgtccttgaagcggccggcctcgaaggcggcgaaggtgcggcgctggctttccagcccgtactcgtcctgcgcctcgcggctgatgccgtagcgggcggccaccacctcggcggtgtcgatcatcggcagatagagttccggcttcatgcgcaggatctcttcgtcggccgcgcggtaggtgttcatcttgtcgttctgcaccaggctgatcgactcgacgccaccggccaccgcgaccggcaccttgtcgtacatgatcgcgcgggcggccagcgccatcgactgcaggcccgagctgcactggcggtcgatggtggtgcccgaggtggtcaccggcaggccggcgaggatcgccgcctgacgcgccacattgccgccggtcgagccctgctgcagcgccgagcccagcaccacgtcctcgacctcggccgggtcgatgccggcacgggcgaccgcatggcggatggcatgggcggcaagctgctggccgctggtgtcgttgaaggcaccacgataggctttgccgatcggcgtgcgggcggtggagacgatgacggcttcggtcataggagcgcttcctcggacgggcatcccggttcgcgggtatgcggggctgatctgcacgcaggcgggcgccgccggccccctcccggccgtggcaccttctctcggaaacaaggctctttcatacgaacgtttgtgtcaacaggcccgggcgaacattccgcagggcggtatcggcctcaaccgtggggaggggcggcagccgcggcctagaccgccagataggcatccctcacatccggccgtgcgtccagctcggccatcgtgccggtaaagcgcacccggcccttctccatcacatagacccggtcggccagcgcgcgggcgacggcgagattctgttccgacagcagcagcgccagcccttcgcgctttagcgtcgccagcatccgggtcatctcttccacgatccgcggcgccagcccctcggagggctcgtccagcagcaccagcgacgggttgcccatcagcgtgcgggcgatggtcagcatctgctgttcgccgccactcatccgccccgccggccggtcggccagttcggccaggttggggaacagccggatcagcgcttccacggtccagtgcggggcgccggggcgggcgtcgcgccggccgacttccagattttccagcgtcgtcagttcggtaaagatccgccggtcctcgggcacccagccgatgccgcggcggacgatttcatgggtcggcagccgcgagatgtcggcgccctcgaaggtcacccggcccagccggcgaggcaccagccccagcaccgccttcagcacggtcgacttgccggcgccgttgcggcccagcagcgccaccacctctcccggtgcgaccgaaagcgacagcccgtccagaatcagcgccgaaccatagaaggcgctcagctcctccactgccagaagagcggcgggcccgtcggtcatctcgtcttatccctcccgtccggcggcgtggcgccaccaagatagacctcgcgcacccgcgggtcggtcctcacctcgtcgggccgcccctcggccagcacccggccgcgatgcagcaccatcagccggtcggcatggccgaaaacggcatccatgtcgtgctcggtgaacagcacgcccatgccggtctcgcgcaccagcgccgacaccagctgcatcagcccggcccgttccgcaggcgccatgccggcagtgggctcgtccatcagcagcagtttcggccggttggcgatggcgatcgccagttccagccgcttgacgtcgccataggccagctcgcccgccgcccgcccggcctgctcccccaggccgatccgatccagcaaggcatttgcatcgtccatatgccgccggtcggcgcggccgaacaagcggaaactctctctgcgggccgcaatcagcgccgcctgcacgttctcgcgcacggtcatggagccgaaaacctcggtgatctggaaggtgcgccccacccccagccgccggatccgccgcggcggccagccggtcacctcggtgcccagcatcaccacccgcccggcatcgggggcaagctcgccgttcagcaggttgaagcaggtcgatttgccggcgccgttggggccgatcagcgccagcatccgcccggcctcgacccggatcgacacctggtcgacggcgcgtaccccgccccaggccttgaccagcccgtctgcctccagcaccggcgtcaccggccgtgcctccgtggcagcagggcgggcagaccgcccagcccgcgcggcaccagggcggccaccaccacgatcagcaggcccagaaccagcttggaaagatcggtgctggcggtcagccagatcgacaggccgcggaacacgcccgcccccagcacggcgcccgacaccgtctccacaccgcccagcagcaccatcgcaagcgcatcgaccgacagcggaatggccagcacgtccggaaacacgctgcccttcagataggcgtggagcacgccggcaagccccgccatcacgcccgcgaccacgaaggccgcccattgcatccgccgccggtccagcccgatcgcctcggcccggcgcggtgcatcggccagggcgcgcagcgcctggccgaagggcgcgaaggtgatcatgcgcagcagcgccacgcccgcgatcgccaccaccgccgccagccggaagaatgctgcggggtcggaaacggcccgaggcggccagacccccagaatgccgttgtcgccgccggtgaccgacacccattgaaaggcgatcgaccaggcgatctgggcgaaggcgagcgtcagcatggccagatagacgcccgaaagcctgacgcagaaccagccgaacaccaccgccccggcaccggccagcgccacgcccgccgcagccgccggccccatcgccaggccgaaaccggtcgcggccagcgccgtgccataggcccccagcccgaaataggcggcatggccgaacgacaccacgcccgccgtgctcatcaggaattgcaggctctgggcgaaaagcgcgaagatcgcgatctcggccgccacccccagcacatagccgccggtcacgacgggcaggcccgccagcagcaccaccagccccgcgatcacggccgcccgcacgggcaccggccagggggcccagggcttgcgcacgaagccggccgcggccccgcgtgccggcgcctcggcccgccccagcaggccctgcggccgcaccaccagcaccaccgccatcaccaggaaggcgatgaccagagagatttcgggcaggaccagaatgccgaaggcgttcagctccgacacgatcaccgccgccaggaaggcgccggtgatgctgcccagcccgccgatcaccaccaccacgaagatctcgacgatgatcccgagatccatggcgtgagaaacggccgcccgcggcagttgcagcgcgccgccgagcccggccaggaacacgcccagcgcaaacacgccggtgaacagcagccgctggtccacgcccagcgccgccaccatgtcgcggtcctgggtcgccgcccggaccagaatgccgaaacgggtgcggcggaagatcaggaacagccccgccaacacgatcggtccagcggcgatcagcaccacatcatagaccggcagcgcctgccccatgatcgtgaccgccccgtcgagcccgggggcgcgcgggcccaccagatcctcgggcccccagatcagcaccacgatgtcctgcaccgccagcgtcagcccgaaggtcgccagcagctggaacagttccggcacgcgatagagccggcgcagcaggacgatctcggtgatcgcacccaaggccgcggtcacggccgctgccgccaggatcgccgcccaccagcccagcgcacccgcccagagcccggcgaaggtccaggccagataggcgcccagcatgtagaaggcaccatgggcgaagttcacgatccgggtcacgccgaagatgatcgacagccccgacgccgccaggaacagcgaggatgcactggcgaggccggtgaggaactgggcgaggatcaggtccaagcagaggatccgctaaagctggggccgggcagcagacagggggtgcgggcgatcaggtgcatcagtctacaccggatgcccgcgcatgtgcgaggacggcggaaggacggctcagccgcccggccggagcttcgccgcctcggcctcggccggcagatagtcggcgccgttgcgatagaccgcgtcgaccatccgccccttgccgtcgaccaccgccgtgcggccgacgaaggcgcccagcgtcgactgatgatcggctgcgcgataggtgatgggtccgaagggcgtgtccaccgccacccccttcgccgcctcgaccagggccgcggtatcggtggagccagccttggcgatgatcgccgcgatcgacttgaccgtcacatagcccacgatcgaccccagccgcggatgatcgttccagcgcgcctgataggcctccaggaacgtcttgtgctcgggcgtgtcgatcgcataccaggggtagccggtcacgatccagccctccggcgcctcggcgcccagcgggtccagatattcaggctcgccggtcaggaagctgaccaccgaccggctcttgaacaggccgcgggtcgtcccctcccggaccagcttcaccagatccgggccgaaggtgacgttcaggatcgcctcgggctccgctgccgcgatcgcctgcaccaccgggccggcatcgatcttgccctgcggcggccactgctccgccacccattcgatatcgggacgcttttccgacagcagcttgcggaactcggccacggccgactggccgtattcgtagttgggcgcgatggtcgcccagcgcttcgccggcagcttcgccgcctcttcggccagcatcgccgcctgcatatgattgctgggccgcaggcggaaggtgacgtcattgcccttcgaccagaccagcgcatcggtcagcggctcggcggccaggaagaacacctcgcgccgcgcggcatagtcggcgaccgcgagaccgacatgggagaagaaggtgccggcgaccagcgccacctcttcgcgggtcaccagctcgttcaccgcattcagcgcatcggccggcttgccggcatcatcgcgcgagacgaattccagcggccgccccagcacgccgcccgccgcattcacctcgtccagcgccagctgccaacccttgcgatagggctcggtgaaggccggcagcgccgaatagctgttgacctcgcccacccggatcgactcggcagcccgcaggggcgcccccgccgccgccatcccggcaacgataccaagcgccgccagcacggcgcgggaaagctggatcctggtcatgagcaaactctctccgcaacgggcccgcagatctggccgcgggcgccggaatgtcctgtcccgcacaggtaatgcttatccggagcaaaagtccaccgcttcgatcagatccgccggccagggaggcatgcgggcatgccgcatgccggtcgccctcctagccgaagcggacctgtgtcaggtcctgcgaaacctcccacaatcgcgccgcggtcttgtgatcctccgcctgcggcgggagcagggccggggccgggaagccgcggagttcgctcatcctgtcagggccgtaatagccgccacccgtcgcctcgggtgaggtcgccgcgtaaagcgtgggcagggcaccccgttctgcgggctgaaacaggaaccacagatacctcctcgccatgccggacaggctctgccggccggggccgtcgcgcagcagcccggtgcgggagacgcccggatgagcggccatgctcgtgatgccccagccggcagcctcactgcgtctctgcagttcaagcgcgaacatcaggcaggcgagcttcgactgactgtaggccggcatcggtctgtagccgcgcgccgcgttcagatcgtcgaaatcgatcgtgccggtgcgggcggcgatgctcgacaggctgaccacccggggatgactgccattcctgagcaatggcaggagatgcgccgtcagcgcgaaatgaccgagataattgacgccccattgcagctcgaagccatccgccgtctgctgtcgtctgggcgggaccatcacaccggcattgttgatgagcagatcgagccttccccacgtcgcgcccagccgcacgccgaaatcggcaaccgagtcgaggctggcgagatcgagacgttcgaaggcgatcctggcgccgggcgtggccgcccggatccgtccgacggcgtctgccccctttgccgcattgcgcccggccaggatcacctgcaccccggcgcgggcaagcgcgcgagccgtttcgtagccgaggccgccggtgccggtgatgacggccgtgcgtccgttctggaaaaggatgtcgtccatggtccatctggtcatctgtcggatccttcgatctcgcggcccgcatcgcggccatgaattgaccactacgcaggcagcgcatcgcgccgggcgacacgatagaccgcggccggcggaaggttgcgcagcgtgccgcccaggcgtcgcgcctcaagaccgagccgatcgaggatcggccgctcgaccgggcatcgcgggacataggtgaactggtagaacgcccctgacggacccaggctggcgaacgcacccgcaagaatggcgaacaccatccgggtggacatcgacagcagaccgaggccactgacgacggcgccggcttccgcaccgggaaacagtctcaaccctgagagacgcacggcactggcatggacgatgttcgcccgtgggaaccgtctcttcagaagtgtgacgaacgccgcgtcgaattcgaccagcgtcagatcccgctcgtcgatcccgcgatcgatcagggcttgggtgaagacgccggtcccggggccgagttccaggatcggggcgtgagaggccccgatttcgctggtgatcagccgtgccagtgcggcgcccgaaggtgccagcgccgcgacccgcaacgggttcgccatccaggcgcgaaaaaaacgggcttggtcggagagcatggatgcattccgtttcatgaacgagggtcccgggaccatcggatctgatgcgatcgtgtcaggcttgggtcgtgcgcaggatcgtccgtgtgcgcccgtcccccacggtctcggtggtggcgagcggcagggagcgcaggcgcaggccggtcgctgcgcgaaccgcatttgcaatcgctgccgcgacggggacgatgccgggttcccccgcgccgcccgggggcaggtcgctcccgacgatctcgaccgtcacggcgggggcgttgtgcaggcgctgcatgggaaagtcgtggaagttcgactgcatcaccgcaccgttttccagcgtgatcatgctgttcaatgcggaggtgacgccgaagataatgccgccctccatctgggccatcaccgcatcgggattgatcaccagccccgcatcgatcgcacagaacacccgatccacggtgatctcgccatccccggcaaccgtgacctcggccacctgagccaccacgctttgatagcagtcctcgatggcgatgccgcgcccgcgccccggcgccatggaactgccccagccggccatcccggccacgcgctccaggacgcgcagatggcggggattgtcgcgcagaagtacccggcgatagtccacaggatcgatccgcgcggtcagcgcgcagtcgtcgatgaagctttccgtgaagaaggtgttgaaggaaaacccgttcgatcgccacagaccgatcggcacatggctgggaacgttctggctgcgcacccgccggttcgggatggcataacagggtttttccagcccttcgatcgccaggcgatcgccgtcgggaccgggcgtgaacggcaggttccggccggcgaccgaatgtatgaccgactgcgtcgcgaccagcgcatcccaggcgacgggcaggccgtccgcgcccagcaccgcgcgcagccgtgcagccgcatggctgcggaacaggccgcgaccgatatcctcttcacgcggccagaccagtttgaccggccttccgcgatggcgtgccgcaagatacgcggcctgcgcgaccacatcctggtcgctgcggcgcccgaatccgccgccgttcatcgtgatgttgcaggtgatgtcggcgacgctgacgccggcgcggccggcgccgctgcgtatcccggtccgcacgctcatgggcgattgcgacggcacccaggcttcggccgacccgtccggccggatgatcaccgtcgcgttcatcggctccatgcaggcatgggccacgaaaggcgcgtcacaggtggcctcgaccagggttgccgggttggccgcgatgaccgcatccacatctcccatctcgacgttttcatagggcgtctcgctgcgcagcccggccctgagtgctgcggacagcgtgctgtcggacacgtgatccgcgtcggtcggcgtccacgcgatctccaggcgtcgggcagcgctctcggcctgccaccactgatcaccaaccaccgcgacactcttgccgtcgatgaccacgacatctacgattccgggttcgcgacgcacctcggcggcattgatgacgcgtgcgacacctgccccaaacacgggagcctggcggatcgtggcgtgcagcatctcggggcgtacgacatcgatgccgaagacgggctcgcctctgaccttggccggcacgtcgacccggggctggtacctgcccatcacccgccattcggccgccggcttcagcggcggatcgtcgggcggcggcatgaaggcggcgtcacgcgcaaggtcgccataggacaggctgcgaccggacgcgtcgtgccggaccttgccgtcgccggtcgaaagctgggcaacgggcacgccgagccgggccgcgccggccgcgagcagcatgtggcgcgccgacgcgcccgcaacccgcatgggatgccacagcgccatggtcgacgccgacgcgccggtggcgatgaagcccgccaggccgagcacgcgccgcccgacccagaccaccggcccgctcgcctcttccgggcgcacgcgcagaatattgaaccagttggaataggccggcagcggctcgaccgggaactccacccggatgcgatcgtcgaagggaatgtccagctcttccgccacgaccatggcgagcccggtatggatgccctgccccatctcggtcttcggaacccggatgaccacgcgaccgtcgccatggatggtcaggaaggcgttgagtgcggcaccgtcgtcgtcgacggagcttgcgcgcccgtccacatcgatggtcgcaagatagccggcaccaccgacggcggcgaccagcgccgtgccgccgagcgcggcgccggtccacaggaaagtgcgtcgggacagaagacggggcatgggaacaccttacgtccgggtcatcatggaggcggcacggtggatcgcgcggcggatgcgcggataggtgccacagcgacagatgttggtgatcgcctcgtcgatctcggcatcggtgggcgcgggggtccgggccagaagttccgttgcggcgatgatgaagcccggctggcagtacccgcattggggaacctgctcgtcgatccatgcctgctggacgaccgacagcctgccgtccggatccgcgagcccttcgatcgtgaccaccgaagcgccgccgaggctgccgatcggatgcatgcaggaccgtatcgcctcgccatcgacgagcacccggcaggcgccgcactgccccacgccgcagccatatttggggccgagcacccccagatcctcgcgcagcacccagagcagcggcttgtgatccggtgccgcgacctcgacccggcggccgttcaccgtcagcgcgaccatccgacgcctccacgaccggttcccgccacggccgggctgaccctgatctgcggcgcacatccgacatctctgcccgtcatcatcgacctccagcctgttgcatctctggaagatgaaaacgaaggccaggcccttcatgccggaacgcgcaaaaaacttgcccgattctccaaggtgctggtgcggtgcggaattcgtgcctaggctttttccgtatcgacaccggcgggagcagcacgatgcggcaggaattgagggaagttgtggcgcgctatgttgcaagccatggcggcccggacgcggtctcgcggacagcggttcaggacgtcatcctcatgtgcagcacgaaagagcgcatgcccttccgcaaggcttacaagccgtcgctctgcgtggtcgttcagggcgccaagcgcatcgagcttgaagatcggagcttcgactattcggccggcagcgcactgatcatcagtatcggcctgccgggcttcggcagcgtgacgcaggcgacgaaggcggagcccttcctcggcatgaccatcgaattcgacatcgccctgctgcgcgaggttctcgatcagatgccctcgcctccgcggccggcggaagaacggctcggcgtctttgtcgaggagctgtcggacccggttcaggattgccttatccggctcgtacagctgttcgaaacccccgatgcggttcccgttctctaccccgcaaccgtcagggaattgtattaccggcttctgtcgggcccgaatggcggcgagatctgcaagatcgcgcgtgccggcagccacacccagcgcatcgcggaagcgatccatctgatgcgcgggaatgtcgggcagccactcagcatcgaggagctggcacatgccgccggcatgggtgtgtcgtccttccatcagcacttcaagacgctgacctcgatgacaccgctgcaatatcacaagcagctgcggcttctggaagcgcggcgcctgatggtggcggaagccgccagcgtgaccagcgccgccttccgcgtcggctatgaaagcccctcgcaattcagccgggaatacacgcggctgttcgggactgcgcccaagaaggatgccatgttcctgaagagtctgcccgtgcagctttgaccgtctgcaccgccgcgatctggtcactgccctccggtcgcagggcatgatatgaacagccggtgaatcaccgtccggaggggccgcgcgtcctcgatccatgccgcaatccatcgtcgatctgctgatgtccgccggtctcgccggggttgcctttctggccttcgccgagaaatacgtgccgatcatcccctcctatgtgatgctcgccgctttcggtgcgctgggcgatcagatggaaggcggcatcgtcgcgaccgtcgtggcggccacgatcgggtcggtgatcggcgcggtcggctggtactgggtcggccgggtgctgtcggaacgcgccgagcgcttcgtcgcccgccgcggccgctatatcctgctcacccctaagctctatacccggatgcgcgacgcctatggccgccgccccttcctggtgacgctgatcgcccagaccattcccacggtccggattttcatcggcctgccggccggcgtgatgcgcatgcccttccggccctatctcgccgccaccatcgtcggcaccgcgctctggaacacgccgctggtggtgctgggcgacgtgctcgccgaaagccggatggacaccacccaggtgatgatgtggttcgcggccgccgtgctcgcggtggaagtcaccgccttcctggtctggcggctgatgcggcggcccggctgatccgcctccgggccgcagcctcttccgctcccccatcggccgcgtgtatcttccgctcttccacttcccgccgcgggcgagaccgccccggcgcagaccggaacgggcatgcgcatcctccacaccgccgactggcatctgggtcaggagctgcacggtttcgaccgcggcgccgagcacgaccgtttcctcgtctggctgctcgacacgctggacgaagacgcgatcgatgcgctggtggtggcgggcgatgtctacgacacggtcaacccgccggtcgccgcccagcagcggctctaccgcttcctgaacaccgccctggcccgccggcccgggctcgacatcgtgatcgtcggcggcaatcacgacgggcccagccggctggaactgccggcgccactgctcgaccggtcgcggatctcgattttcggcgccctgccccgcagcgacggccggcccgatcccgcccgcacgctggtgccgctcaccgatgaagccggacaggtggccgccgtggtcgccgccatcgcctatccccgcccgggggatctgccggtcgacggcggcggtgccgcggcgctggccgcgatctatgccgaggctctcgccgccgcccgcgagcgcttccccggcctgccggtgatcgcgaccggccatctccacgtcaccggcggcgacgtttcggccgaaagcgaacggccggtgatgatcggcggcgaggaggcgctgtcgcccgacctcttccccgagggctatgcctatgtcgccctcggccatctgcaccgcgcccaggggctgaaagccgccatgccgctgcgctatgccggcgcccccttcccgatgtcgatggcggaacgcagctaccgccattcggtggtgctggtcgaaaccgacgggtgcggccccgcaacccaccggctgatcccggtgccgcgcccggtcgcctttctgcgcgtgcccgaaaccggggcgctcgaccccgaggcggcgctcgccgcggtcgcagccctcgacatcgccccacccgaaagccccgatctccgcccctatctggaggtcgtggtcgcgatcgacgcccccgtccccgatctccgccgccgggtcgccgaggcgctgggcgatacgccggtgcgccttgcccgggtgcgttcgctcagccgcggcagcggcggcagcctcgccgacggcgccagcctgccgcccgccctcgacgagatcgatccggccgacgtcttcgcccggctgcaccgccagcgtttcgataccgacccgcccgacgcactggcccgcgccttcgccgaactgctcgccgacgcccatgccggccccgacaccgatgccggggagaccgcctgatgcgcctgctccggatccgcggccgcaacctcgccagccttcaggacgatttcatcatcgatttcgaggccccaccgctcgcccatgccggcatcctcgcgatcaccggcccgaccggcgccggcaagtcgaccctgctcgatgccgtctgcctggcgctctacgatgccctgccgcgcaccgccggcgctggtgcccgcggtgagacccgcgacctcgccctcaatgacggccgccggatcctcagccatggcgcgggtgaggccgaggccgaaatcgatttcatcggccgcgacggccgccgctaccgggcgggctggagcgtgcgtcgcgcccggggcagggccaccggtacgctgcaggcggcaaagcgggtgctgatcgatctggaggccggccaggtggtcgccgacggcaagcgcgatgtcggtatcgaaatcgcggcccggatcgggctcgatttcgaccagttccgccggtcggtcctgctcgcccagggcgatttcgacgcctttctgcgcgccgatgcccgcgaccgcgccgatctgctggagaagatcaccggcaccggcatctatggccggctgtcgcgtgcagccttcgagcgcaacaaggccgcccaggccgagatcgagcgcatccgtcttcagcttggggagcaccagccgctcgacgacgcagcccgggccgaggcccaggccgccgcggaggcggcgcgtcatgccctcgccgccgcccgtgcccggcaggaggccgccgccgaaaccctgcgccgcatcgatcgccgcctgtcgctggaggcggcccggaccgccgcggcagaagccctggaagccgcccgccttgccaatgacgccgcctcccccgaccgcgaccggctggcccgcaaccgccaggccctggccgctcgggccgaactggcggcggcggatgccgccaccgccgggctggcccggacccgcgagcggcttggcgcggccaccggcgcccttgcccgggccgaggccgatcacgaagccgcacgcactgcccggaccgaggccgaagccgccgtcggccgctgccgggacgaagacgccgcccgcgccccgcatctggccgaggcgcgacggctggacgaacagcttggtgccgccgcccgggccctcgcccaggcccgccgcgacgccgaagcggccgccgacatcgccaccggccatcaggccgcctccgaccggctggccgccgtcatcgctgccgccgaggcccgtgagaccgccgccctggcccgactggcagcgctggcggcagccgccccgccggtcgccgatccggaggccgcggccgaaaccatcctggagcgtgcgcccctcggtgacgaactgcgtcggctgaccgtcgggctcgacgatcttcaggcgcgcgaccgcgccgatgccgcagaggccgaccgcctcgccgccgcccgcgacgatgccgcccgccgcatgaccggccttgccgaggcgatcaccgccgccgaggccgaggccgaccaggcggaggcacgggcactgcgccgccgccgcgaccggctggtcgagatcggccatcacctcgacgacctctccgaggtgatggttgcagcgcttgaggccacgcgcgcccgcgacgcccatgccgccacggccgaagacgcgatgcaggctgctgcagccgcaactgccgaggccgaacgccaccgcgccgccctgccggtggtcgaagcgaagctcgaagaggccggccgcgccgccgacctgtcatcggccgcggccgaggaacatgccggccggctgcgtgctctgctgatcccgggtgcgccctgcccggtctgcggttcgaccgatcatccgacccgtgcgatcgacgacctgctcgcccgacggctcgacaccgaccgcgcccggctggccgatctcaaggccgagcttggcgccctcaccaccgccctcgcccgggcggaagaacgggcgcgcgccgaaacccgccgcgctgccgacgcagccaccgcccgtgaggactcggcggaaaccctcgccgctgcgacggccgaccacgaggcactgctcacccggctggcagatgaagcggccgaggccgggctcgatgccctgccgcccctgcccgccgccgaagccgctcacgaaacgaccgaccatcggccgccggctgcccgcctcgccggctggcgcgaggccgtcaccgatgcaatcgaggcggccgaggttcggatcacgacgatcgacgccgccgccgcccgggccgccagcctccgccgcgaccacactgccgccacccgcgatcgggatgcggccgccgaagcgctcgcccgcctggccgcgcgccgggccgaagccggggccgcgatcgcccgcggcgagcagcgccgcaccgatctcgccgcccgcatcgcccggctggacgagcggctggccaccctgctcgatgccgcctgtcccgactggcggaacagcctcgccgccgacgccgcgggcttcgccgccctgatccgacgccgggccgccgaactggccgaagcgcagagcaccgccgaagccgcacgggccgagcgcattcgcctcgcccctgaccatgccgccgcccgggtccgcgccgaaaccgccgccgacgccgccagccacgccacgacacttgccgaggagtgcgcccgcagccatgcggcccttcaggacgcccgcaccatgctgctcgacggccggtcggtcgcggcggtcgaggccggggcagaggccgcccgcaacaccgcgcgcatggccctcgatgccgccctcacccgcctcaccgaggctgcgaccgcccgcgcccgggcgatggaagcccgccatcaggcagaggtggcggtgactgccgcggcagaaacatccaccgctgccgatgccgcgctcgagaccgcccgcgcggcgctcgacatggatccggacaccctgcgcgcggtgatcacggccggtgcaccggcgcttgatgccgaggcccggcggctcgacgcgctcgcccgcagcctggccgaggccgaggcgacgctccgcgcccggcaggaggatctggcccgccatctcgccgatccggacaccatcgcctcgggggccgacaccgccctgcgagaggtcgcggaggccgcacatgccgaagcggccacatcctgcaccgcagcggaggccgcctgccgcaaggctgaacagcgcctcgccgaagacgacagccgccgcctggccgcaggccggcttgccgccgcactcgccgatgcccgggccgcggcggacgtctgggcgcagctgaacgagctgatcggcgccgccgacggcacgaaattccgccgcttcgcccagtcgctcaccctcgaccggctggtcgccggcgccaaccgccatctgggcgagctgcacccgcgctatgcgctgcgtcgcatggagggcgctgagatggcgctggaggtggtcgaccacgacatggccgacgaggcgcgcgcggtgcacaacctctcgggcggcgaacgcttcctggtcagcctggcgctggccctgggcctcgccgatatttccgccggccgcgggctcgccatcgaaagcctgttcatcgacgaaggcttcggcgcgctcgacccggacgcactcgccatggcgatctcgatgctcgaacgcctgcaggccaccggccgccgggtcgcggtgatcagccatgtcgaggcactgaaggaccgcatcccggtccagatccgcgtcaccccccggggcgccgggcgctctggggtagaggtggtctcgggctaggcacggcttccgcgcataaaaaaggggccgcccgcgggcgacccctcttcagtctgccggccagccgtcggtcaccagccgccggtcaggccgccgcgaccctggtcagcgcgccgtccaccgtcgccaggatgtggtcgatatcgtcggcggtcgcgatcagcgccgggctgaagcacagcgtgttgttgaagccgggcagagaacggttggtcatgccgaccagcacgccctcggcatcgcaggccgcgatcaccgcctggacgcgggcttccgccagcggctcgcgggtctcgcggtcggcgaccagctcggcaccggcgaacaggccggccccgcggacatcgcccaccatggcgtgcttgtccttcagcgcctgcaagccctccatcagccgcgcgcccatgacctgggtgttctccagcaggccctcgtcctcgatgatccgcatgttctccagcgccgccgcgggccccgcagtgcagccgccgaaggtggagatgtcgcggaaataggacatcgggtcggcggcatcctcgcggaacatgtcgaacaccgcctcggtggtcaccaggcaggcgatcgcggcatagcccgaagccacgcccttggccatggtcaccatgtcgggctcgatgccgtaattctgatagccgaaccacttgccggtccggccgacgccgcagaccacctcgtcgatatgcagcagcacgtcgtatttccggcagatctcctgcacccgctgccaatagccctcgggcggggtgatcacgccgccgccggcggtgatcggctccaggcagatggcgccgacggtgtcggggccctcgcgcaggatcacctcttcaatcgcatcggccgcgcgctcgccgtaattctccacatcccactgcttgcgatattccaggcagtgcggcacctcgacgaagccgggggtgaacggcccgtactgctcggcgcgctggggctggccgcaggcggacagcgccgtgatggtggtgccgtgatagtcgcgctcgcggaacaggatcttgtgcttcttgccgccatagcggcgggccgcgatctggcgcaccatcttgaacgccttctcgttcgcctcgctgcccgaattgcagtaatagacccggctcatgcccggcatcttggaaatcaaccgttcggcgaagcgcgcgccggggatcgagcccgcggagccggcgaaatagttgatcttcatcagctggtcgcgcaccgcattcgcgatgctctcgcggccatagccgacattcaccgtccacacgccgcccgacagcgcatccaggaactggcggccgttctggtcccagaccgacatgcccttgccctcgacgatgatccgcgggtcgcgggcatcgaagacccgatgttgcacgagatggtgccagacatgggcgcgatcggcttcgacgatatgggacaggtcgttttcagacatcgtgacggctccggttcggtcgggcctgtggcaacaggtccgtgatcatccatcgagctacgccgtttcgcgcggccgcgacaggtccacggcccgtcattctatggaaccacgaccaacgtcctctgccgctcccgccggcacaatgtccggactgctggctttcctgcccggctttcgtgcaatactgaccgggtacgacctcccaggaaggcccccgcatgtcgatatccgtcctcgaacggcagagcgacgaatcgatccagtcgcagttgcgccgctcgatcatcgcggccattcacgccgggcagatgaccccggggcagaagctgctgccctcgcgccggctggccgaacagctcggcatcgcccgcaacacggtcaccgccgtctacgaggaactggtcgcccgcggctatctcgacgccctgccccgccagggctatttcgtcggccgcggcctgccggcggatgccggccagatccggaaagaggcgcaggcgccgctgcgcggtggggcgatcgactggcagggccggctgaaacaggccccgtcgacgctccgccacatcgtcaagccgtcgaactggcaggatttcgactatcccttcatctacggtcaggtcgatcccaacctcttcccgatcaacacctggcgcacctgttcccgcgatgcgctgggccgggccgccatcgactggtggaccgccgatcgcgctgtcgaagacgacccgctgctgatcgagcagatccgcacccagatcctgccccagcgcggcatcttcgtgcgcgaagaccagatcctggtgacgctgggcacccagcagggcatctatctgcttgcccgccttctcgcccgccacggcacgcgggtcggtatcgaggtgccgggctatcccgacggccgcaacatcttcgcggccgaacaggccgagatcgtcgacctgccggtcgatgccgaaggcgccgatctttctgcagccggcccgctcgacctcgccgttctcacccccgcccatcaatgcccgaccatggtttcgatgagcgagcgccgccgcgaccgggtctacgccaccgcccgcgcccatggcacgatcctgatcgaggatgatttcgaaggcgaactctcaggatcgggagaggcgggcacgctcaaatcccgcgacaccgacggccgggtggtctatctcggcaccatgtccaaggtgctggcgccgggggtgcggatcggctttatggtcgccgatgcggcgctgatccgcgaggcgctgtggttgcgccggctgatgcaccgctccacgccgctcaacaaccagcgcaccgccggcatcttcctggcagagggccattacaccgccctgctccgctcgctgcgcaccgcccatgaactccgctggcgccggatggccgacggctgcgaccgccacctccccggcttccgccgatcccccgccactggcggttcctgcctctggctcgaatgcccgcctgaaatcgacggccgcacgctggccgagcgcgccgccggcctcggcgtgctgatcgaatccggcgaccccttcatgcccgaagcccaggccggccgcttcatccgcctcggcatctcctacatctcggaacgccggatcgatccggggctggaaaggctggggcgggcggcgcgggagatcgggcgcatgacctgatgtgatgcgacgggtgcccgcgaccggcaaaaggcctcagatcacctttgctggccgcgcagttcggcaaccgcttccgacaggcgttggatgccttcagggatcagcgccttgtcgatgcaggaatacccgatgcgcatccacgagcgaccgtcttcggggttttcaaaattcttgctcaattcttcaaaatacacggatcgacgcgccgccgcttcctgcaaggccagagtgtccagcatgtcggcaaaactgagggagcaactgctcccgccaaagcgcacacgatcgtccagttccggcagccaggtgtgcagcgccttgcgcataatgtccgagcgggcaatgtattcctgtcgcagccgtgcgatgaacctgtcgaaatgcccgcgctccagaaaaagccccacggaattctggttgttgatcggcggatgccgcagaatatggtgacggaaagagcgcgcctcggtcacgaaatcgcgatcggccaccaggaacccgatccgcaggcccggcatcaaagactttgtcaggctgccgacatagatgacgttgccatagcgatcgagcgccttcagcgccggcacggctttctcgtcgaaggtcgtctctgcctcatagtcatcttcaatgatgaagatgcccttctcgcgtgttttttccaggaacgcatggcggcgcggttccgacatggtgatcgtcgtcggatgctgatgggtggtcgtcacgtaaagacagccacactccaatgcttcgggcgaaagtatcaggccctcttcatccatgggaaggtggcgtacccgatgcccgtccatccgggcaatattcgcggcctcgggatatccgggattttccacgcccagaacgccgcgtctgctcagcaaaagcttcagtgcgatgtaaagcgcgttctggccgcccacggtgatcagaacctcgtccggattggcatagatcccgcgcggctgaagaacacgcaagatcagctgctgaaccagaagcgggtcgtccacggtagaaaaatccatcgcccaattgcggatctggagggagttcaccgaatcgcgcacgcattcccgccaggcaccgacagggaatatgttcggatccacatgcccgcaaatgaaagggaaacggaaacggacaagcgcatcatgcggcttggtcgtacgcggctggtcataggtcgcgccacgaaaatgcgccttgaaatcaaatcgatcggcatcttcgcgggcggcatcccgcataaccgctgcgtcgcggatcgcgtgggcatccggtgaaatgtaatagccggaccggttcttgctggcgatgaacccatcctgccgcagcgcgtcataggccagagagaccgtgttgttgctcacattgagccgctgcgcgaaccctctgaccgacggcaatgcataattcggcggaaatcggccggagaccacggcgatggcgatctggcggcgaatctgcatctgcagactctccgtcgaatgacggtcgagccggatgaagttttcgatcatttggctcaccccagacttccgcagctctgcctgcaggggagcggccggaaagatgggctgaatttaacgtcgccctgcggggatcaccagtgttttggcccggggcaacgggccgcagacggcaccgatcgggcgggctgtagccatggatagatgccatctgcacctatgcaagcgtttcctgctccagtagcgattcatgtgacgcattctgcaaacgtccggggccgggcttcacggtctccgacgatggcctggatgcacccgcttcgcttcgttgaaacaaagaaaccttgaataacagaggaacaggaagcatgacgtcggacatctggaaactttccgcagtcgacatcgccaccgccgtccgcgccgggacgttcacggcggtcgaggcgacgcaatcggcacttcagcggctggaagcggtcaacccgctgatcaatgccatcgtcgactacaaccccgagcgatcgctggcacgcgctgccgagattgacgccatgatcctggcgggtcgcgatcccggaccgctggcaggtgtgccggtgacgatcaaagtcaccaatgacgaggccggcttcgccacgacctttggcgtggtcgcctacaaaaacaacatcgcggctgaaaacggcccggttgtcgacaatctcgaacgcgccggtgccgtgtcgatcggacgttcgaacatgccctccttcggggtccgatggttcaccacctcccggctttatcccgacaattacaacccgttcgacaagggcatcacccccggcggttcctccggcggagcggcatcggccgtggcgagtggcattggtgccatcgcgcatgggacggatattggtggatcggtgcgctacccggcctatgcctgcggtgtgcatgggctgcggccgacgctgggcagggtgccgaactacaatcccagcctccccgaacgcgggatttcgggccagctcatgtcggtgtccggcccgctggcgcgcaccatcgacgacctgcgcctggctttcgaggcgatggcacagcccgacccgcgcgacccctggtatgcgcccgtcccgctgaaagggccggatgtcccccgccgggtggctctgtcactgcgaccggacgggctggatacgcaggatgccatcgtcgaagccctgcttgacgcggcggaacggctgcgcgacgcagactggcaggtcgacgagatcgacaccatcccgcccctgaaagaggccggcgaggcccaggtcaaactctggctctccgaggatttcgacggcacgctcgccgcggccgaggccgatggcgatccgggcgtgatcgccatgctgcgcggtcaggagaaactggcccgctccataggcttgcccgaacttcacggcctgctgaagacccgtgccacgcttgcgcgcaaatggcagatgttcttccaggattatccgatcctgctgatgccgaattcggccgaattgcccttccccttcaatgaagacctgaaggacgcagaggcctatcttcgcgtctgggatgcccagcttccccagctcggcattcccttcctggccctgccgggcctttcggttgcaaccggcatgaaaggccggtcgccggtcggcgtccagctcatcgccgcccgcttccgcgaggatctgcttctggatgccggagccgacatcgccgcgcggggcggccctgcggttccgattgatccgcgttgacggatccgtcgcctgaaacgccggtctgacggcagcagccacaccagctcccgcgaggcgctggtgtggccatgccacctgtaccaggggctgaccggcatcctcagacgcccgggccaggacataccggccggacaatcctggcccatcccaacctccccccctggccctgtccccctttgccccaccctcatagcgtcggaaagaccgctgctgatgagggaagccgatgtccgaaccgatcaaggtcttccgcgcccggaaaatcctgaccatggcgcgcaaccgccccgtcgccacccatgtggcgctgcgcgaggggcggatcctggcggtcggtgatgccgaagatgcggccggctggggggcgccgatcgatgatcgctttgccgacaaggtgctgatgcccggcctggtcgaggcacattgccatgcgatggaaggtgccgtctgggccgataccttcctcggcttcttcccgcgccattcccccgaaggcagcctggaaggcgggatcagatccatcgaagacgcggtccagcgcctgcagcgggccgaagcagcactcaccgatcccgatcaaccgctgctcgcctggggcttcgatccgatctattacggcggcgcgcggatgacccgccatgatctggaccgggtgtcgaccacccggccggtgctggtcatgcatgccagcttccacatcatgaacgtcaacacggtggtgctggacaagggcggcctcttccaggtcaccggcgtcgagggcatcctgcgcgacggccagggcgacgtcaccggcgagttgcaggaaatggcggcgatgcagtatgcccgccaggccgtgggtgcgaaattcgccctcaccgaaaccagcatcgcctcgctccgccgtttcggccgctctgccaccaatgccggcgtcaccacctgcaccgatctgtatgcgccgctcgacgatgccgcactcgatgcctatgtcgccgccaccgcggccgaggatttcccggtgcgcatcgccccggccatggccgccgccgcctgggcgcccgagactggcatcgcccgcatggcggttctgaaagagcgcgccaacgacaaattccgcccgggcctcgtcaaggtgatgaccgacggctcgatccagggcttcaccgcccggctgaaatggcccggctatcacaacggcgcccccaacggcatctggaaccagccgccggccgtgctgaaggcgcagatgaaggcctataacgccgccggcatccagatgcacatccatgtcaatggcgaccaggcctcggaattcgccatcgactgcctggccgaagcgctgaccgaggcccccttccccgatcatcgccacgtgcttcagcactgccagatggccgatgccgcgcagttccggcgcatggcggcgctcggcatcgccgccaatctgttcgccaaccacatctattactggggcgatcagcacgccgccctgaccatgggccccgatcgcgcccggcggatggatgcctgcggcaccgcgaaggccgaaggcgtgcgcttcgccatgcattccgacgcgccgatcaccccgctcgcccccctcttcaccgcctggtgtgcggtcaaccgacagacggccaccggccgcgaacttggcccggaagaaaagatcagcgtcgccgacgcgctccacgccatcacgctgggcgccgcctggcagctgcgtctcgaccatgtggtcggctcgatcgaggtcgggaaatatgccgatttcgcggtgctggaggacgaccccaccgggatcgcgccccaggcactgaaagatgtccgggtctggggcaccatcctgggcggcatgccgcaccagagcgcgatcggggccgcgtgatggcgtcccccggtgcgcccgatgcacggcccaccatcccggtctcggtgatcggcggctttctcggcagcggcaagaccacgctgatgaaccggctgctggccgaaagcccggcccgcaccgcggttctggtcaatgatttcggcgaaatcaacgtcgatgccgccgtcctcaactccggcgacggcctcaccttcgaactcgccaatggctgcatctgctgttccatggccgacgggctcgcttccgccatcgcacgggcggtcgcggccggccccgcgcggatcctgatcgagaccagcggtgtgggagagccgcggcgggtggccgaatacgccctgctcgacccggccctgcatctggatctggtggtgacgctcgccgatgccgccaacctgcccgaccagctggaagatccgctggtcggcgacaccgtcgcccgccagttcgacggcgccgatcttatcctgctcaaccgcgttgacatggccggcccgcaggcgcgcgatgccgcccgggcggcgctgcgccgcctggcccccggccggccggtgatcgaaacggtgcgcgccgagatcccggccgcgctgctggtgcgcgacgagatcaccgtcttcgcggccgccccgcacggtcatcatcacgccggccacgaccgcatcttccatccgctgacgctgaccgacccgcggcccttcgaccgtgccgccctgaaccgggcgctcggccgcctgccgcgcagcctgctgcgcctgaagggctgggtgcagttcaccgatgcgccccgcccccagctgctgcaatgggtgcaggggcagtgggaattcggccccgaggcggcggaccagacatccgccacccggctgatggccatcgccagcgcccccggcctcgatctcgccgccctgctgcgcggcgacgcagactgatggccgcccccttcttcattctcgccccccggagccccgcatcatgaccgtgcagacgtccacagcccaggccgcccccataactccaactgcccccacagctccggccgccgacgccatcatcgccgcctggcagggcctgaacctgatcggcggcgagcggcttgccgccgcagcgaccctgccggtgatcgcgcctgccaccggcgcagaaatcggcgtcaccgccgcatcgggcccggccgaggtcgatgccgccgtcgcggcggcccgggcggcctggcccggctgggcggcgatgccggcacgggatcgcggccgccgggtcgccgccgccggccgtgccatcctcgacgagctggaggatctggcccgggtgctggcgctggaaaccggcaaggcgatccgcaccgaatgccgcggcgagctgcgcaccgccgccgacatcctggaattctatggcgggctcggatcggaactgaagggtgagaccgtccccttcaacccgcgcatgctgaccatgaccacccgcgagccgctgggcgtcgtcgccgcgatcctgccctggaacgtgccgctggtgctgatgatgctgaagatcgcgccggccctcgtcgccggcaacacggtggtggtgaaggcatcggaagaagccccctacgccaccttcgccgccgccgcgatccttgcccgccatctgccggccggcgtggtcaacgtggtctcgggcaccggcgccgtctgcggcgcggcgctcaccgcccaccccgatgtcgccaagatcaccttcaccggatcggaagcggtcggccaggcggtctacgaggccggcgccgcccgcatcgtgccggtcagcctggagctgggcggcaagagcccgatgatcgtctgcgccgatgccgatctggccaaggctgtcgagggcgcggtttcgggcatgcgattcacccgccagggccagagctgcaccgcctccagccggatctatgtccatcaggacctttacgacgccttcctgggggcgctcaccgcccggctcgaccagctggtgatcggcgatccgctcgacgaggcgaccgatgtcggcacgatcatttcggcgaggcagatggcgaccatccgccgctatctggatctggccgaggccgatggcgcccgcgtcatccgctgcggccgtctgccggaagatccggcccttgatcctgcgctgttcatgcagcccaccctgctcaccgacatcgccgatgatcacccctgcgtgcaggaagagatcttcggtcccgtggcggtgatccagccctgggccgattacgacgcggtgatcgcccgcgccaatgccactcattacgggcttgcggccacggtctggactgcctcgctctcgaccgcgctcgatgccacacagcgcatcgatgccggctatgtgcaggtgaaccagaacctgaccatccagcccaacgtctcctatggcggcttcggccgctcggggctcggcaaggaggcctcgctggaggcgatgctggagcacttcacccgcaagaagaccatcgtcatcaatttcgactgagccggagccggatgtcgggcacccttcttatcgtcgttccggccgtcttcgcggcggccatccttcgcgggatcaccggcttcggcttcgcgctggccgccgtgccgctgatgagtctggccgttccccccgcccaggccgtcgcggtggcgctgctgctgcaaagcttcgtcggcctgcgcgacgtggtggcgctcagggccgataccgaccatcgcaccctcgccttcctgtcgctgggcgcggttctgggcaccatgcccggcatctggctgctcgaccggttgagcccggatgtgatgcgcatcgtgatcgccggcgtggtgatgctcggcctggccgtgctgatcggccgcccccaggggctgctgcgcccgggccgcggcagcgcggtcggcgccggcctggtggccggcctgttctcgggcctcgccgccatgccggggccgccggcgatcgcgtatttcctcggcaccgccaccccggcgaaacgggtgcgcgcctcgctgatggtcttcttcttcttcacctcgctcatggctctgccgggcctcgccctggccggccagctgcatcgcgaccaggtgatcgcagccctggtggcgctgccggcgctgctcgtcggcacctgggccggcggccgggtcttcgcccggttgagcgagggcaattaccgccgcgccgcgatcggcctgcttgcgatcacggccggcatctccgccttgcgggggctgaacggtctgccctgaccgcggccctcccgaccacacaccagacgaccacgagacagacgacccaaaaacaagaccagagctgacagagaggccgaaacggccagatcgacctgacaagaacgggggacggcatcacatgctgaacagactgaagcagttcacgctcgcggccgcggtcgcactcgccctcggggcaacggcactcggcgggacaggtgcgcaggcagcacccgaagacggcggcacgctggtggtcggcaccacccaggtgccgcgccatttcaacggcgccattcagtccggccaggcgacggcgcttgcctcgacccagatcttcgccagcccgctgcgctatgacgccaactggacccctcagccctatctggccaaaagctgggaggtggcggccgacggcctgtcggtgacgctgcatctggtggagggtgccaccttccatgacggccagccgatcacgtcggaagacgtgaaattctcgatcatgacgatcaagaagaaccaccccttcaccaccatgctggcgccggtcaccgacgtcgagacgccggacccgcagaccgcggtcatcaaactcgcccatccgcatccggcgttgctgctggcgatgtcgccggcgctgatgccgatcctgcccgaacacgtctatggccagggcgacatccagtccaaccccgccaacctgaagccggtcggctcgggccccttcatgttcgaggaatacaagcagggcgaatactataagctgaagaagaatccgaacttcttcatcaagggccgcccctatctggacgaggtgatcgtccagatcatcggcgacccgaccagcatggtgctgtcgatgcgccggggtgatctggacctggtgccctatgtctcggccgtccgcgacatccagatgctgcagaagaccgaggggctgaccgtctcggacaagggctccgacggcttcggcgcgctcaactggctggccttcaacacgaagaagccgcccttcgacaacccggatgtgcgccgcgccatcggctatgccatcgacaagaaattcatcctggagcgcctgctcggcggcgtcgcccagcgggcctatgggccgatcgtgccctcctcgccgctcgccaccgatcaggtcgagcactacgacctcgatctcgccaaggcgaaagagctgctcgacaaggccggcctcaagcccggtgccgatggcgtgcgcctgaagatgaccgccgactacatccccggcttcaccgatcagggccgcaacatcgttgaatatctgcgcacccagctccgccaggtcggcatcgaggtcgaagtccgtaactcgcccgacttcccgacctgggcacagcgcatctcgaactatgatttcgacgtcaccgaagacaacgtctacaactggggcgacccggtcatcggcgtgaaccgcacctatctgtcgtcgaacatccgcaagggtgtgatctggtccaacacccagcagtacagcaacccggaagtcgaccgcattctggaacaggccggccaggagatggatccggcgaagcgcgcggcgctctatgccgagttccagaagatcgtcgtcgacgacgcgccgatcctgttcctgaacgtcacgccgttcaacacggtctacaaatccaacctgaagaacccgccgctcaccatctggggtgccgcctcgcccatggacgaggtctactgggacaagaagtaaccgtctctgccggcgcgtgggtggtgcggcctgcccgggccgcatccacccccatccattcccccgcgcccgcccgtcccacccgatccacgagccggggcacgacatgaaacgcctgcttccccttttcagccgcctggcatcgaccctcggcctgctgctggcggtggtggtgctgaacttcctgctgatccagatggcgccgggtgatccggtctcggtcatcgtcggcgagatgggcggcgcctcggaagagctgatcgcccgcatgcgggcggaatacgggctcgaccagccgctgcacgtccagctcggggtctatgtctggaagatcctccacggcgatttcggcttctcctattatttcaaggaaccggtgctgtcgctgatcctccagcggctgccggccaccatcctgctggtggtgacggcacttgcggtcgcggtgctggtcggcaccctgctcggcatcttctccgcccgccggccgcgcggcccgctcaactatctggtgacgctggtctctctcgccgggtattcggcgccggtgttctggaccgggctgatgctggtcatcctgttctcgtcgatcctgccgctgttcccggtctcaggcatggccgatgtccgcggcgccgaaaccttcctcggcagcgtggccgatgtcgcccaccatctggtgctgccggcggtgacgctcgcctcgatctacatcgcgatctattcccggctgtcgcgcgccaccatgctcgacgtgctgggggccgattacatccgcaccgcccgcgccaaagggttgagcgagcgtcgcgtggtctatggccatgcgctgcgcaatgcgctgatcccggtggtgaccatggtcgggctgcaattcggccagctcttcgccggcgccgtgctggtcgagacggtgttcaactggccgggcctcggccggctcgccttcgaaagcatcctgcgccgcgactacccaaccctgctcgggatcctgttcttctcggcgatcctggtggtggtggccaacatcctcaccgacatcgcctatggcctcgtcgatccgcgcatccgcacccgcaagcccgctgccgcgcgcaagcccaaagccaccggagccccgcgatgaccgaccagaccgccaccgccgcaggcgtcaccgcgcccgccgccgacccggccctggacgcaccgcgcccggtgcatccggccgtcgagttcttccgcgccttcgcccgcaaccagtcggccatcctcggcattctgctgctggccctggtgctgcttgcaaccttcctcgggccggttctctacccggtcgatccctattcgatggtcgacgtgcccttcaccccgcctttgggcgactacgcgcccttcggcaccgattatctgggccgcgacatcctggccggcatcatcgccggcggccgggcgacgcttgcggtcggcggcaccgccgccgccatctcggtggggatcggcattctgatcggctcgctcgccggctatttcggcggcgtcatggatgcggcgctgatgaaggtgacggaattcttccagatcctgccgccgctgctgctggccatggtactggtcaccatcttcggcgcctcgctgccgatcatcaccgtcgcgatcggcgcggtcgcctggccgcaggtggcccgccttgcccgggcggaattcctgcgcatccgcaagctcgactatgtcgccgccgcccgcacctcgggcgcccgcgacgcctatctgatcttccgggtgatcctgccgggggccctgccgccgctggtggtggcggcgggccttgccgtcggcaccgccatcctgttcgaagcggggttgagcttcctggggctcggcgatcccaacaccatgtcctgggggctgatcatcggccagaaccgcaactacctgcttgatgcctggtggaccgtcaccctgccgggtgtggcgatcttcatcaccgtcctggcgatcagcctggtcggcgacggcatcaatgatgcgctgaaccccaagctgaggaagcggtgatggccgatccgatcctctccatccgcgatctgaaggtcgaggtcgacatcggcggccggtcgctctcggtcctcgacggggtctcgctcgacctttatgccgggcgcacgctggccgtggtcggagaaagcggctgcggcaagtcgatgaccgcactcgccaccatgggtctgctgcccgaacgtttcgccgtcaccggcggcgagatcctgtttgacggcgaagacctgacccgccttgccgccccgcggctgcgccagctgcgcggcaacgccatctcgatgatctttcaggagccgatgacctcgctcaacccggtgatgaccgtgggacggcagatcgccgaagtggtcgaactgcaccagggccgcagccgggcggaagcgcgcgagatcgcgctggaaatgctgcgcgcggtccacatccccggccccgaacagcggctcgacgcctatccgcacgagctgtcgggcggcatgcgccagcgggtgatgatcgccatcgcgctggcctgccggccacgggtgatcatcgccgacgagccgaccactgcgctcgacgtcaccgtccaggcgcagatcttcaggctgctgcgcgaactccagatggacaccggcaccgccatcctgctgatcacccatgatctgggggcggtcgccgacatggccgacgaggtcgcggtgctctatgccggcaaatgcgtcgagcgcggcccggtcgatgccatcctgggcgcgccctcgcatccctatacccgcggcctgatgtcctgcacgccacggctccgcctgggggccgccgcccttcagccggacccgcgcggcctgggcgagatcccgggcatggtgccgccgctcggccgcttcccgcgtgcctgccgcttcggtccgcgctgcggcctggccgatgcccgctgccatgccgaggcgccgccgctggtgccgaccggccccgcccatacggcactctgctggcacgtccccccccattccgcggaggcgcggccatgagcctgttttcggtcgaagacctcaaggtccattttcccctgccctcgggcaagaccgtgcatgcggtcgacggggtcagcttccaggtcgcagagggggaatgcttcggcatcgtcggcgaaagcggctcgggcaaatccaccaccgcccgcgccctgatgcgtctggtcgatccggtcgagggtcacatccgcctcgacggccatgatctcggcaccgccgcgggcgaggcgctgcgccggctccgcccgatgatccagatggtgtttcaggacccgttctcgtcgctgaacccgcggctgcgcgccggggccgccgtgcgcgagccgctggacctgatgaatctgggcgcgaaatccgaccgcgacgcccgggtcgacgccatgttccggcaggtggggctgcaccccgatgcccgccggctgttcccgcaccagttctcgggcggccagcgccagcggctgtgcatcgcgcgggccatggtcaccagcccgaaactggtggtctgcgacgagccggtctcggcgctggacgtcgccatccaggcccagatcctgaacctgctcaagggcctgcagcgcgatcgcggcctcacttacgtcttcatctcgcacgatctggcggtggtgcagcacatctgcacccgggtggcggtgatgtatctgggcgaattcgtcgaacaggccccgaccggccggctcttcgccagtgcccgccatccctatacctggtcgctgatggcctcggcgctgtcgccggaacgtcatgccggcggggcgcctgcggaccgcttcaccatcaccggcgaaccgccgagcccgatcgacccgcccccgggctgccgcttcgccggccgctgccccttcgccaccgaccgctgccgcaccgaaaaaccggccctgcgccgcttccccgacgaccaccaggtcgcctgccactatgccggagagctggaaccgccgatcccggaactcagggcggcgtgagatgcgggggcagccgaccgtcagatgatcgacggtgccgcccccggctgatcctcaaccgttgcgatactggaagctgtaggcgttgatcgccggtaccccgcccagatgggcatagagcacattggcgcccttcgggatccggccgctgcggatcagatcgatcatcccctgcatggatttgccctcatagaccgggtcggtgatcatgccctcggtgcgggccgccagccggatcgcgtcattggtcccggccgagggcacgccataggacgggtaggcatagccgcgctccagcaccacgtcgtcggccgtgatcggccggcccagcccgaccagatcggcggtgcgctctgcgatccgcaggatctgggcatgggtctcgtcgggggtggcggaggcgtcgatgccgatcacctgttgcgcacggccgtcggcggcgaaacccaccaccatgccggcctgggtgctgccggtcaccgaacagacgatgacatggtcgaagtgcacgcccagctcgcgttcctgcgctcgcacctcttcggcaaagcccacgaagcccagcccgcccaggcgatgatccgacgccccggccgggatggcatagggccggccgccgcggcggcggacatcgtcgagcgcctgttcccagctttccttgaacgagatgccgaagccggcatcgaccagctcgacctccgcgcccatgatccggctcatcaggatattgccgacccggtcatagaccgcatcgtgataatcgacccagttttcctgcaccagccggcagcgcagccccaacttcgccgccaccgccgccacctggcgggtgtggttggactggatgccgccgatggtgaccagcgtgtcggccccctgggccagggcctcgggcaccagatattccagcttgcgcagcttgttgccgccgaaggccaggcccgaattgcagtcctcgcgcttggcccagatggtgacgtgcccgcccagcgccgccgacagccggtccagccgctcgatcggggtcgggccgaaggtcaggcgatggcgcgcgaaacgatccagatgcatggtcgcaacctccctcgaaagttgtgggcggctccctccgtccaccctggaatcctgttgcgggcccaagcttcaggcaaatgcgttatcgggccacattctcgaagaattggtctcgatctcgacaatttattgcgcctgattgcatcatttacggtaatcacgcagtttttctgcgtcagccgaaggggcccgacatggaagaggatcacagcctggaccgcatcgaccgcaacatcctgcgccagttgcagcgcgatgcggatctgccgaacaccgcgctggcccagagggtccatctcagtgccaccgcctgcctgcgccgggtggaaaagctgaaggcgcgcggtatcattcgccgcacggtcgccatgatcgatccggaagcggtcgacatgacaacgctggttttcgtcggcgtggtgctcgaccgctccacccccgaaagcttcgaagatttcgaaaccgcagcccgcagcctcagcggctgcctggaatgccatctggtggcgggcgaggtggactatttcctcctgctccgcacccgcgacctcgcccgcttcaacaagttgcacgctggcgaaattatcaaacttcctggcgtgcgccagatccgcacctttttcgtgctgaaagaaatcctgtcgaccaccgaactgcccgtgtgagggggcggtctgacgggggctcagcctcgccgcgcctcttcagccaccggcaccaccgcctggcccaccggtccgtccttctccgtaccggtgatcagccgggcaccgcgctgcagggtcagataatcccacagccatttgaacgccacggcgatgcgatagcgcagcccgaccaggaaatagacatgggcgatgccccagaacgcccagccggtgaagccggtcagcttcagcccgccgcgtttcaccaccgccgatcgccggccgacggtcgccagatcgccctcatgacgataggcgaaggggccgggcacggccgtcccggtcactcgggcgcggatcacccgcgccacataatcgcccatctgcttggcggccggcgcaatacccggcaccggccggccctcggggccggtgacggcggcggtgtcgccgatcgcaaagatctcggggtgccccggcacgctcagatcggggccgacctggatccgtccggcgcgatcgcgcggtgcctcgatccatctgccggcgggggaagcgaccacgcccgcgccccagatgatggtcgaggccggaatccgcccgccctcgatcgcgctgcccgcggccggcgtcacgccctcggccagggccaccgacacgccatccatgtcgcaggcggtgacccgcacacccgtcgccacctcgacgcccatgctgtccagcgagcgccgggcataatccgacagatcctcggggaaggcgggcaggatgcgcggcccggcctcgaccagcacgatgcgggcggcgcgcggatcgaccagccggaaatccggcggcagcaccttgcgggcgatctcgacgatggcgcccgccatctccacgccggtcgggccgccgcccaccaccacgaaggtcagcagccggcgccgctcgtcatccgaccgcgccatctcggcccgctcgaaggcgagcaggatccgccgccggatggtggtcgcatcctcgatccgcttcagccccggtgccgcccccgcccagtcgtcatggccgaaataggaatgggtggcgcccgtggccaggatcagctggtcatagggaatgcgcgccgccccggcccgcagctcgcgccgcgcggtgtcgacgccgtccacctcggccatcagcaccgtggcattggcctgccggcgcaggatggcgcggatcggccaggcgatgtcggcgggcgacagggtcgcggtcgccacctgatacagcagcggctgaaacaggtggtggttctgccggtcgacgacgatcacctccaccggcgctccgtccagcgccttcgccgcctgcaatccgccgaagccggcacctgcgatcaccacccgcggccgccgtccattggcccgaacctcgccgggcgccggaacacgatccgaagcggtggtcacctcgggcggatgaagatcggccatgatccggctcctgctgctgtggcgcactatcatatgggcagacatccccccatccgccacccgaaccacgccccggacccgcgggttccccctgcccgggccccccgcgcatatcccccttgcaagccaccccacccccgggcgatcatccctccctcagccccgatctccgcgaaccccaagcacacgtaaaaaccccgggaggttcgcacgccagattccccttatctttcaaacacctgcattttgcagtgacgtcacacacataccaccgcatatctcgccccgaggttcgcgcaaatcggcttttttccgacgctgaatcaggatattaaaagggggtgagtcgcaccccttgcgggtgcgtggattgaaacaccttcgacgcggtgtatgacgcgccatcgacaggtcgcaccccttgcgggtgcgtggattgaaactcgatgacgaccgagtggagtgccccgggtgcctcgtcgcaccccttgcgggtgcgtggattgaaaccgcggcgatccccgccagcccgccggggtgtgcgtcgcaccccttgcgggtgcgtggattgaaaccgaaaaaatcgaaacaaaccgctttacagggaggtcgcaccccttgcgggtgcgtggattgaaaccgcggtgctcggtgccgacacgctcggcatcgaggtcgcaccccttgcgggtgcgtggattgaaaccgcagatgcccgcaccgttttgatttgtaatacggttgcaccccttgcgggtgcgtggattagtaacaaagcgccgatcgaccgctccgggacgcatggacatcgccggatcaggaggtaggagatggccaccaccagcagaatctccatcactctcgcaccggaactgaccgacgccgttcatgccgcagtctcctccggagagtatgcgaccgcggccgatgtcgtgcaggatgccgtgcgggaatggaaggagcggcgcgacctgccgggctacacggtcgaagagctgcgtgcagccgtgcaagaggggcttgagagcggccgcagcacgcttgcgaccatggcggaggtcaaagccgaggcacggcgtcggttccgggcaccggccccgaccatgcggcccccacaacgctgaggcggcccaccccaaagaaaaaccgccggagagtcccctccccggcggcattccgtccgttcctggccgtccgccccgtccgctcacccggcccgaagctgccgggtcaccgcgccgacattttccgacacgtcgcccacatcgcgggcgacctgagtgatgctggcggaaatctcgcgcgcggccgcgtcctgctgggccaccgccgaggcgatcgaggccgagatggtctgaacctcgccgatggcggccgagatcgcgtggatcgcgtccaccgtgcgggcagcctcgcgctggaccgaggcgatctgttcgacgatttcgtcggtggccgaggcggtctgctgggcgaggttcttcacctcgccggccaccaccgcgaagcccttgccggcctcgccggcgcgggcggcctcgatggtggcgttcagcgccagaagattggtctggctggcgatgttgttgatcagcttgatgaccacgccgatccgctcgccggccgcaaccagggcctgcaccgtctcgttggtgcgcgtcgcctcgttcgccgcggtggccgacgcattggcggccgcgctggaacgggcggcgatttcgcccaccgaggccgaaagttcctcggtcgccgtcgccacgacctgggtgttggcggtcgcccgatcggccgagctgccgacccgggccgagagcgtgtcggcgatgtcgtggatgcccttgcggcgattggcctcggcgcgctcgttctcaagctccgccagcttctgggcatggatgtcgatcagagagccgcaggcacgcagcgggttgcccttggcgtcgcgggccacgccgccgatcgccttgaaccaccggtaactgccgtccttcatcttcaaccgataggcgacgtcatagccggtgcggccgctgcgatcgttcaggcaggcaccgaaggcgtcgaaagtcgctgcggtgtcctcgggatggatacggtcggaccaggcgttcaccttgtcggggaagccggtcagatcgtcggacccgaagcccaccaggcgacggaattcgcccgaaaaacgccactgtgccttcggatgcatggcgtcgccctcgtagagcagggcatcccaaagaccgataccggcatggcgcgccagcagggccatgcgctcgacatcgaccttctggtcatgcacgtcgatcagcgagccgcaggcgcgcagcgggttgccctgggcgtcgcgggcgacaccgcccacggcacggaaccagcgccagttgccgtccttcatcttcagccggtaggtgacgtcatagccggtgcggccgctcttgtcgttcaggcaggcggcgaatgcctcgaaggtatagccggaatcctccggatgcagccggtcggaccaggactggaccttgtcggggaaaccctgccggtcgccatgggcaaagcccaccagccggcggaactcgtccgagaagtgccacgaggccttggcatgcatcgcgtcgccctgatagagcaccgcgtcccacaagccgacgcctgcataccggccgaggagttccatctgacgggccgcttctccgtcggccccctgcataccgtcattcttccgccagaacatgatgcgcgcctgttgatggtgtgaacctgcgcagcatcttcatgtgcgggcgatgaagaatacgttaagggtgggaacttgcgacgaagcgccgcaacgcctgcagaatattcaggaaagctgtcctatcttgtccggatacgtgattttctctcgctggtttcttatgataaacagtcttcgcgttcagtgcccgccgatgaacgccgccagctccggcgtacgctgtgcagcgaacagttcggcaggcgcaccacgctcgtgaatccggccctgatgcatgaacaccaactcgtcgcagacttcgcgggcgaagcgcatctcgtgggtgaccatcaccagggtcatgccctcttcggccagacggcgcaccaccgccagcacctcggccacaagctcaggatcgagcgccgaggtgatctcgtcgcagagcagcactctgggccgcatcgccagcgcccgggcgatcgccacgcgctgctgctggccgcccgacagctgatcgggcgtgtgatcgaagcggtcggcgaggcccaccttggccagcatctcgcgcgccaccgcctcggcctcggccgtgcccatcttcttcaccaccttcagcgacagcatcacattgccgccggccgagagatgcgggaacaggttgaactgctggaagaccatgccgaccttcagccgcagcgccttcagctcccgctcgctttcacggccgtcggcgcgttcgccgtccaccgtcaccacgccgtcggtcggccgttccaggccgttgatgatccgcagcaaggtgctcttgcccgatccgctgcggccgatcagcgccaccacccggccctcttcgaccgagagatcgacccccttcagcacctcgaccaggccgaaactcttgcggataccggccagttcgaccagcggccgcatctgatcagcgggcgacatggagcctcctttccagccggcgggcggcgaatgacagcgggtagcagagcgcgaaatagatcagcgccacgaaaccataaacggtgaagggttcgaaggtggcattggcgatcatcgtcccggccttggccagttccacgaaaccgatgatcgaggtcagcgccgtccccttgaccacctgaaccgagaagccgaccgtcggcggcaccgcgatccgcatcgcctggggcaggatcacccagcgcatgcgctccacataagacatggccagggcctgggcggcctcggactggcccttgggcaccgcctccacgcagccgcgccagatctcggccaggaaggcgccggtgaacagcaccagcgacacgatcgccgccgtccaggccgagacctcgatccccgccagcggcaggccgaagaagatcaggaacagctgcatcagcagcggcgtgccctggaaggcttcgacataaccgcgcgccagcatcaccggcaggcgccggcccgagaccagggcgaacagcgccaccagcccgaccacggcaccgccggcaaaggcgatcaccgacagcaccacggtccagagcgcggcatcgatcaggttgcgcaggatgtcgagcgtaccgaactcaaccatggaccgcacctccggtggcgggcgcagcccggccggcgctcagggccgcacggcgtgatgccctgtagagcagccggtcgcccagccggcgcaggatcatccgggtcaggatggcgagggccagatagatcgcggtcgccgccagataggcctcgaaagcgcggaagctgcgcgactggatgaaattggcggcgaagctcaactcttcggccgcgatctgcgagcagaccgacgagcccagcatcacgatgacgatctggctggacagcgccggccagatcttgcgcagcgccggcaccagcacgacatggcggaagcattccgcccgggtcatgcccaggctcgccgccgcctcccactgccccctgggtacggcctgaatgccggcgcggatgatctcggccgaataggcgccgagattgaccaccatggcgatcatcgccgcctccacctcgcccagccgcacacccgccgcgggcaggccgaagaagatgaagaacagctgcacgatgaacggcgtgttgcggatcagctcgacataggcggccacgatccccgccgccaccggtatccgctccgatcgcgcccaggcacacagaatgcccagaaacacgccgaaaatgccgccgaccaggatcagctccaccgtcagcaccaccccgcggagcagcacgtcggaataggtcaggatcggcgtaaaatcaaactgataggccatggacgaccccttccgggaacggtgggccgatggggagaccgcatggcgcggggcaagggggcggccccttgccccgccggccgcctcagagatccgccggcagcggtgcgcccagccaggtttccgaaatcttcgacagccggccgtcggccttggcggcggcgatgatctcgttcacctttgcaaccagtgccgcctctcccttcgcgacgccgatatagcagggcgagttcttgatcaggaacttgggctccggccgggtgcgcgggttgcgctccagaatggcggccgcaaccacattgccggtcgccaccagctccacctgccccgacaggaaggcctggatggtaccgttattgtcctcgtaacggcggatggtagcctcggcgggggcgatcttggtgagttccagatcctcgatcgcaccgcgggtgacacccaccgtatggccggccagatcggcggcgcccgcgatcttcagatcggccgggccgaaaacgccgttgtagaacggcgcataggcattggtgaagtcgatcaccgcctcgcgctccgggttcttgcccaggctggagatcaccagatcgaccttgtcggtggtcaggtacgggatgcggttggcgctggtcaccggcaccagctcggtcttcacccccagcgcatcgccgatcagccgggccatgtcgacatcatagccgcgcggcgccatgtcggggccgacggagccgaagggcgggaaatcctgcgggaccgccacgcgcagcacccccgccttctgaatggcatccagccccgccgcctcggccgtgatgccgaagccgccggcggccgccaccagcacggcagccgccatcgcccccagcacgctgcgccgccgcaacccggttccgatccgcctgatcatcgccattccccgcactccccgcttgttgacgcctcgccctgatcgcccggccccgacccccggtcgggacggccggatccggcacatcccgcggccccctgttgccgctgctcatgttttaagcgtgcccattgtttaagcatgagtcaacgccgttttttgccttaccccagcatgccacccctggcatccgcttgcaaacccatagaaatccggccatgcttccggaaatccagccggtccaactggtctgaccggtctagccgaaggagccggatttggccggagacagcgtccccgaatacgttgccgagcgcctgcagcgcatgatcctggcgggtgagcttgcccccggcgaggcgctgccggcccagcgcacgcttgccgaacgtctgggtgtcagccgtacatcgctcagggaagcgctgaccgtgctcgaaaccctgggcctggtgcgggtgcgggccggcaagggcgtcttcgtctcagacccgtccgccgacgacaccgccccggggccgcgtggcgaccgctacacccatgccgcccgggtctatcagctgcggctggcgatcgagcccttcgtctcggggctggtcgcgatcaccgccgccgatgccgaaatcgaccggctggccgagacggtggccgagatgcgcgcggcgcttgccgagggcgatctggtacgcgccgcccaggcggacggggacttccaccagcggttactggtcgcggccggcaacccgctcttcccggcggcgatgcgcccggccgggccgatgctggccgaaacccggcgcattcccttcgccaaccgcgaaagcgtgcgcgcgccgctggacgaacatgaacgcatcctggcgcagatccgtgcccgcagcccgcagggcgcgcgcgatgccatgcaccgccacatcctgtccgccgccagccgcgccggtgtcggcgtgctgcggccctgatcgtgctttcagcccccatgaacgaaacggacatcagatccatgccgagctttgcccccaccgccgccgtcaacctcgcctcccgcgcgctgggtgcgcgcacgctcagctgttccgaccagttcttcggggcgctggagcggctgatcgacgatgccgccccggtcttcatccccggcagatacgacgaggccggcaagtggatggatggctgggaaacccgccgccggcgcgatgacggccatgactggtgcgtgctggcgctggccgcccccggctggatcgacgcgatcgagatcgacacccgccatttcaccggcaactatcccgccgccgccggtctgtgggcgctggccgcagccgacctggccgagacccccgctgccgatgatccgcgctggcagccgatcctggcccccgtgccgcttcagggcgatgcccccaacgccttcctgcccgatccggcggtgcgcacggcggaggggcagccctggacacatctgaagctcgacatcttccctgatggcggggttgcgcggctgcgcattctgggccgcccggccggcctgccggcgccgcgcgccgacgggctggtggagctgtcctcggccctgggcggcgcccgggtgatcgcctggaacgatgctcattacggcgacccgcgcaacctgctgctgcccggccttgcgccacgcatggaggatggctgggaaacccggcggcggcgcgaacccggccacgactggtgcatcattcgtctggcgacgccgggcagggttgcatttatcgaaatcgacacgcgtgagttcaagggtaattatcccgacacctgctcggttcagggcgtgatggcgcccgatgccgcggatgcggccaccgtgccgcaaagcctgttctgggcagagatcctgacctcccgcaagctcggaccagatgcgccgcacggctttacgcccgatgcggatcgcgtggtgtcccacatccgcttcaacatcttccccgacggcggcgtcaaccggctgcgcatcttcggtgtgcccggcgccatggagtgagcgtccagatgcaggcttatccccgcaccatcttaaggccgcggcacctgacccgcgcggccttcgcccccttcggcgaggttctcgacgccgccgatcccggccgcgcgccgatcgcgatcaatggcggcacgacgctgcgctatgatcagctcgcgcgggtggagacggatgacgagggctatggtgcgatcagcctgtttcaggcccatgaagcggtctcgctgccgctggtgatcgaggtgatggaacgtcaccccctcggcagccaggccttcatgccgctcacccgctgccgcttcgtaatcgtggtggcgccggccgccagccgccagcccgatccggcaaacatgcaggccttcgtcaccgacggccgccagggcgtcagctatcgccgcggcacctggcacctgccgctcacggtgctggacatggcccatcttctggtcgtcgaccgcaagggccccggctgcaacctcaacgaacacgtcttcgcccccggcaccggcccgctgctgctgccgcaggaggtttgacgcctcccgcgggctcggcgccagggggcaccacaatagtcaaaggcccttcattgtaattaacttgaagaatatgatctaatattcttaaataaatcctcgcaatttgaggtaaatttccaattcaagaggaaatcgttcgttcggccagctggatataagttgcttttcataaagtatctgacacgcacgcacataggccatctggtcgaatgcacagaggctgcgcgccatccaagccatcacggtatcaagtaagctgaggcggccgtccacagtttctcgcacaaacgggtacattacaaaggcagactcgttggagggtggctcgaccccctcttcgacgagagtaagaagatcacctttggaaattcgtcttattctatgattcaaatagccaagctcatgtacaacactcgatcttgtgtagtatatagtttttcgtttattttcgataaatcgacgagtgacgatatccttggttaatagaacgattgcgtaggtagcttcattgagggcctgataaattgcatccgggatcctctcaccgacctccgccatgacatacttcggctgcacggtaaaggagacctcactcaagccttcatcagttgaagctgattttgagaatacacggctaatgaaatcgtggatgtcttgtgccacctgattgggcttcttccagccaattgagctaacctcccaactacaggcgataaatacctgcgcatcttgactgagaccatcatgaatgcggactgaatttctgaagaaatgcttcgaaagatgcttaacagacgcccgcaatccgggagaactcgtacgagaatcaatcaggcggaacttgtctcgatgatcgacattctccggtgggcggatttttcccttatctactgcatcaccatacaataaagttgcagcatgataccaaatatactcaaaatcctgactcaatgttttgaaatacccttccctctttgcttcctgctcgagattctgcacgcaaatcacaggtaattggctagcaactgccggccacatgttctccaacttagaatatgtatatatatcataatatatacaccgatttagaaacacgcctcgatagttgagcgggacaggcgtgaaacgcagttcaatctgattgtaagtgaggcttacttgactccgacgaatacgctcacgcagataatcaaattgctgcaacgttttactctggaactgcacgaacatttcctgatgctcgccgtttgtggtcccaaaatcgagctcgccaaattcgacatcgtctcgatcgaagatgtcccagaccggcttctgctgctctttctctcgcatcatcaaccgcatcgcataatctgaaaaggggtaagctagtataaaccggagggataatgagattttcctacggttcaattcaacaatcgcattcatgagcttgtcaaattcgtcgagaaaggcctgagaggctctgtgggccttgtctccataacctatgacgggcttgaagaaggtggagcaggaaacccccatggaggcgatccggatctggcccttgcaatcgtcgcggccctgtactgccaccacctcgtcagaggctagccgtaacctttcagtcatatgctcgaaatattccggggcaaacctactcttgaaaaaaataggattttcatcaatcaactttgctccccccccaacctccgcaaaattctatagagatagaagcccttgcggtcattttgatcaccccagtactaagctaccagggaccttaagcacccggctggccatctgcgccgcacgcgacaacgtctcgccgagaggcttgttgttgatcgcaccaacaaaaaaaacaccggcagcagcatcccccgccccagatgtgttcacaatgtcctccgatcggacgggcacagcgtccgccgcagcgcttacattcctccagtttgcaaccatccccccctcacccattgtcagcaatgaaaagggaacaaaatgccgtatcgggtgactggaaaaaccgaaatgcgtaagataagattcagacacatcaggcatcaatgtacgatattcagccaagttacccgcaatcgcgaagatacggcccatgcggatatggtcgagaagccggcgcaaggttcttcccaccaagatcacatgattgcccagcgacaatgctatccggaagcgacgcgcttcgatgcaccggtggagcatctcggcgagatcaccctgctgaagctcatacgcatcaacaatcagtaaatcaggtgccagtgcgtcaagatccattcccgcgctcgatctcgatactcccggataaaataatagaattttttcggggttcctcgtcccagcgacgactagcccagtgggattaacaccttcgagcagagggctggaatgcattattcccatggcgcagatttcgcgagcgaaaaagctagcaacgggagtcagcacaccgcctcgtaacgccaggacggacacataggtcgcgacacagcggatggcaggttcaagcgcagcaagcatcgatagagtgcttccacccgcaaccgccgtgaaatgtgtctgtggtaccgtgagcagctcttcaaaattaaggacatcaagctcagcgagcaatctctcaaaattgtcctcagagacaatctcgcgccactcacctgcaactacgcccgcagtctggcaaaaccgtgtaaaccgagcatcggctaaggtcatgctgatatctacaagactcggaccgactgccacaactttacgcattattataacctcgcatcgtcgcgatcgaccaagcagttgtcacgaaagaccgttaggcccttcacaccacagcgataggcatcacgaaaaagctcaaacacggcatccacggtacagttctgatcgaggttgatggttttcgaaatgccgtcgtcgagaaaagattgaaatctagcttgaaccatcaaatgaaatagaggcttgatgtcctgtgccagcgagacaaacggcaatttccgcagtcgatcatcatacctattttcatcatcgtctttatcttgcaccaatttcagatctcgaaataccttaaacagcatgccgtctcgatcacgcaatgaaatatacggctccaaactcttcgaaataccagcgatctcactgctcgtaccgctgggaggcattgaggtcgtcgacgcgttgcgcacaccgtagcgcatgatatcgtcaatcagcgcattccactgatcgcggtcgatccggagtaatttgccctcaagcttgcgggccacccaggagcgatcccgaaaccggctttccgcaatggctggaaaagcaccgcgttctgccgccagtgccactgaagcgcgcttcgtatgaaagtcgagcacttcggcgatctcggcggccaaaatcgcggtcgcgtggctgtcataaggtaaatgtaggtgcagcagaagatcggcgaatcccgtgatgccaataccgatgcgccgtttctgtgcgaccaggggaagcgcatcgctgcggccacgcacggtcacttcggtcaccgcatcaagcatgcgcacaagaagagcggcaacttctcccagcaatgccatatccagcgcatcgccccgtacgagattactaacgttaatgtagctgaaatgacatgcatcgccctgcgccattgccagctccgcacaaggagcagtactgacatagggccattgcggagtcggattgtcacgttcgaggcgatcacggaacaacacacccggatccccgcaataatgcgccgagactgcgatctcacggagcaaatcgcgcgccgataatatctcgaccacatttccggagcagtcacgcaactcccaagccttatcgacctcgaccgcctgaaaaaatgcatctgaagccaacattgagatgttgagccgccattcagcaaaatcgacgttgcgcttggcccgcaggaacgccctgatacgtggatgatcgtcacgcaaggtcgccatgcccgccgcggggcgcttatttgcagcccgcaattcgtggtccactgcgacaaggtgggcattgagctgcggcaagcataagtcgggccaagcaagctccgacaagtcgaagccaacgccggttgcctcggccagcaacgctgccgacgtgcgcagcaattccgagtccggctcaagttggctgtcacaacgcgggcgcaatacagtacaagccgccgcggaagatatctcttgtgcgacattctgtagaagcggcgtccccaacaccactatgccctcgtgaatcaacgtttcaagccgtgcgccgaagtcggctgtgtccgcgccgcccagctcagcatcgatttggcatagtttgtctatgagacggcgaaacgcgccagcgacgctttgccccgggatcagtaggccgcggttttccatgatgaggcgagttcggctgccgaaagcactatcgagatcaaccatcttcgcgcccccgccaacgatgccctacggcccctcagttgaagcaaaaagaatacgccccttacgtcgaccgcgccagttcgacccagtgtggttccgacagaatggttccagcgaaaattccgtcgagcgccacggcgacgcgcggcaccatgttcttgggcaactggtctatgtcaaaccatctaatatcgtcacatttatgcagttcacagttcgatatttcgccggaaaaaatcgacgctttaaagtaaaaatcaatccgctcttgccctggagcatctcccggctcaggcggtgtatgtacaacgtgaatcaactgtagtgcctcttgagcgataaaaatacctatctcctcttccgcctcgcgcgcaatcgcacggctcagcggttcaccaccgtcgaggtgaccggcaactaagctataatagccgtccatataaccggtacctgctcgacggagcatcagcaggcgctttccttccatcaacacgagataaaccgccggaatgatctgatgccgaaaggtcatggggaggtagacctgccaatgtgtgagagtcatcgtatttcatgatacttgggctagcgcccaatggcgacgggaatgataccggccggatttcgaactcagattaaagccgcttacagcttgctcaaagccatgtttcttccaaattgcaccgattttatgccgccgacggtgctggacatggcccatcttctggtcgtcgaccgcaagggccccggctgcaacctcaacgaacacgtcttcgcccccggcaccggcccgctgctgctgccgcaggatctctgatcgctcagccggacggatccttcagaaacgcccgcgcccgcggatctgccgcggcggcgatgttgatccgaagccacggcccctcctccagccctggccggaacaccgcgccggagaccaggccgatgccgcgggcggccgccgcgtcgaccagcaggcgggcatcggctgcgtcttcatgcgccgcccagacgaacatgccaccgcggggttcggtgaacagccgccagccggcccggcgcagcgccggcagcagggcggcgcgctggcgggtcaggcgccgggtcagcgcttctgccgtgcgccgcaggccgccggtctcgatcagcaccgccatcacctgttcggcgaagcgcgacgaggcgaccgaggacagcatcttcacatcgaccagcccgcgcatccgcgatggcgccgccgccacatagccgaccctgagtgcggatgagagcggtttcgagaaactgcccaccatcaccacccggtcgagcccgtccagcgccgccagccttatggccggcacgccctcttcgaagtcggcatagatgtcgtcttcgacgatggtcaggtcgtggcgcgccgcaaccgtcagcaggccatgggcgatctggggcgtggtggtcgatccggtcgggttgtggagcacgccgttggtcacgaacagccgggcaccgcttgcggccgccgccgcgtccagcgcctgaagatccggcccgtccgcccggcgcggcaccgccaccatccgcacgccctgcaggcgcagcaagccgaacagattgtgatagcccggatcttccaccagcaccgcatcgcccggcctggtcaaggcacggatcaccacatccagcgcctggctggcgccggtggtcagcatcacccggtcttccgccaccggcaccgacagccgggccaggcgctgcgccaccagccggcgcagccgcggctcgcccaaaggcgtgccataatcgatcagcgcccgcccgccctcgcgcgtgacccggcggatggcgcgcgccagatcggtggtgtcgtgccagtcgtcgggcagtcggccgccgcccagcctgagcagcgccggccggtcgtcataaagccgccacacccggtccgccaccgccgccaccccgcccggatcgggggcggccggcggcagcggtgctgcaggcgacgccacccggaaccccacccccggccgcgacaggatgcgcccctcggccaccagccggtcataggcctcgaccaccgtgttgcggctcacccccgtctctgccgccagccggcggatcgacggcagggccgcacccgcagccgtctccgccccgcgcgcctcgatccaggcgatcacggcggcgaccagctgatcggccagcggttcggggcggctgcggtcgaggggggcaatcaaactgcgggcctccgattgaacagggcgcgccaaccgtaccgccagtcaaggggtacggtcgagcggtcatgatgatcgccgttaccggaagccggggccggaaatctgtgcaacgaccggttcgacgaggtctggggcggcctcgtccacaggcatccgctgaaccgtacctgtcgcttccaggtacagtctggtcgtctccgggacgccctgtccctggcgaggggcgggatcccgcggcagcctgaccggcgcggcatgtccgccgcgcctgggaagctgccggatgaccacagatctcgacaccgccgcaccacaccacgcccgcaccggccgaccggggcgactggccttcgccctgctcaccgtcaccactgccggcaatctgttcaccccgctcagcgcccggctggcggaagccgatggccaggggactgccatggccgggctcgccttcgcggcctatgtcggcggcgcgctgccggtgctgctggccggcagcggcctgcccgatcgtctgggagcgctcaacaccgcgaggctcgccctcggccttgcgctcaccgccagtctggtcatgatcctctggccgggcattctcatgctcggcctgtcgcgcgccctgctcggcatcgccgtcgccggcacctcgaccctcgcgcccgctctgatggccgcgcaatgcccgcccggcaccgatccgcggcggatcgcggcgcgggtttcggtcgcgaccaccttcggcttcggtttcggtgcggcgctcaccgcgctctgcctgctgctcgatccgcagtcctggatgcaacccgtcagcggcccgatctggatcggcatggcacttctggccctcaccggcctgcacggcctgcccgatgcactgcgcctcacctccgggggcaccggcctgcgctggcccgctttcccgcccggcaccctggtcttcggcggcgcgatctgcatcgcctgggccgtggtcgggctggtgatcgcggtgctgcccgccagcctcgcccgggccgggctcggcgcccatgccggtttcgccaccttcctggtgatcgtgcccggcatcctgacggtgccggtggcccggcgcatggccccggaacgggcaatccgccgtggcctgctggcgctggtggccagctatccgctcatcgcctggggcgccctgtcgggcagcatcgcggcggtcttcgtcggcacggcgctggcggccaccgcctgctacgggctgatccatgcgggcggcctcgccggcgtgctgatgcgggccggcgaggccgccacccgggcgaccgccggcttcttcctgctcgcctatacaggcttcagtctgccggtgatcctgaccggtgccgccgccgaccaatggggacagacgacggccctgacgggtttcggtgccgtgctctgccttgcagcgttgatcctgtggcgtcattccactatctctaccggccacaaagactttccgacgcggcctgcggagacccccgaccaaaatgctgaccaacaagggcaaatacgggctcaaggccctggtacacctggcaggcaaagagccgggtgaattgtccctggtctccgacatcgccgccgagaacgagatccccaagaaattcctcgacgcgatcctgggcgagctgcgcaatgccggcttcgtgcacagcaagaagggcaagggcggcggctataccctcgcccgcccggcatccgacatccggatcggtcatgtgatccgggtgctcgacggcccgctcgccccgatcgcctgcgccagccgccgttcctatcgccgctgcgaggactgcaccaacgaggaacagtgcgccgtacggctgatgatgatggatgtccgcaatgccatcgccggcatcctcgacaaccgcacgctcgccgaaatgcgcaatctgtcggatgccgaccgccagaccctgatgtaccacatctgatggcaagcgcagccgccgccgtccccgagatcaccgtcaccgaagggccgctgccgcctttgcctgacgcgccgccgctggatgccggcccgctgatccggatcgaggccgaccgcagcatccgcctcaccggtcccatcggcggtgcctgccatctggatgccgccgccacccgcgcggtgctcgacaccaccggtgccgccgatcccgcggccgcccggctgctgcttgcggaagacatgctccccggccttgcctgccatatccacggcctgctgccggtttcgggcacggcggtggtgatcggcgggcgggccgtgctgctcgccggtgcttccggcagcggcaaatccctgcttgcggccgaactcctcgcccgtggtcatcatctgctggccgacggcatcgtcgtgctctcgggcctgccagggccggccctcatcctgccgggcccggccgggctcaccctgcatgccgatgccggcgcccgctatgccggccgcatcaatgccccaccgccgcggatccggcgggcgggcgtgccgcgattgcgtcatctgccgacggcgcagcacacgacctccctgccggttctggcgatcttccacctctggcagaccatcggcggccgcgatctggaggtgttgccggcccgtggcctcaaaggcttccagaccatggagggcaacgtccgccagcttcacgaaggccgtatcctgcgcggggctcgtccgatcttcgccgaggtcgcggccctgctcggccgtgcgccgctcactcttctgcgtcatcgccgcgactggcaggccccggcccggctcgccgatcatatcgaggccatgccatgaccgcgcaccacatcacgccgggcgacggcttcgtctgggtgacggcctatcccaaatccggcagcacctggctccggctgtcgctgtggagcctgaagcatggcggcgcggcgccggatttcgacgtgctcgatcagggctggctcaccatggccagcaaccgggcgcttttcgatcgcagcctcggcctcgacagtgcctggttcaccgatgacgaggcctccagcctccgcccggccgccttcgcacggcggctgacggcggaacccggcctgcatctccatcgcacgcatgaggcgttcaccgccacacccgagggtcgaccggtcttccccgccgcactgacccgcggtgccgtttatctgatccgcgatccgcgcgatcttgccgtttccaatgcccatcactggggcctgtcgatcgatgccgcgatcgatctcctgacgcagcccgacgccgccctcgacaccggcggcgacggtctttacggccagctccgccagccgctcggcagctggtcggcccatgtcgacagctggaccgccgccgctttggggtttccacggctgatcatccgctacgaggacatggtcgccgatccgcaccaggccttcgcgcgcatcgccggtttcctcggctggcccgatgatccggcaaccgtcgccggtgcggtcgccggcaccacattcagccgcctgcaacaccgcgaagccgaaaccggcttcaccaacgccgccgcccccggccgacgcttcttccgccagggccgcgccgccggctggccgagcgcgctcacccccgcccaggcggcccggatcgaagccgcccatggcacggtgatggcccggttcggctatcgctgactgatccacactccttttacgatgaagaccggctgtcgatcaggcatcgcggagacctcccggcttgaatacaatcattttgaagctccaagctgagagaatatgttctctgctcaaaatgaaagctgaagtaacatgatgaagaagatctgcaaccagaagatctccacctcgcctaaagcctggcacaagccccagctgagccagatccggacgtcaacgacggcgtttgctctccgctccagcgccgacggcaaaaccgccgtctcctgatccggctctcgccgcgccggcaaccgcacccgccggatcaccccgccggcgccttgggcaccggcggggtgatccgggccacacagcccggggcgccgcgctgcccccggcccgcttcgcccgactcgcggccgcccatggcgcgacaatcgccctgtccggcggctatcgaccgatccgcaccccattcagaaatgacgatcgaccgtcgacttggcagatagacatctcgcgtgcgaatactgtaatcatattgctggctttaagccgaaagtgtgatccctctatccagcaatgaaagctgccaccacatggctaaaaaggtcgacaaccggaaggccctcccctcacgccaagcctggcgtaagcccaagctgagcctgagccccgcatcagaaacggcgttggccaccggaccatattatgacaacgtctccggcacatcctgatccctttcagtttccccccatcaaccgtccagcgtcatagccgccggcgccccggataccggcgtggtgatccgggtcaaacagcccggctcgccgaattgctgatgtcggaaaccgctatcggtggcatgaccaagctcgacagcgacgacaacgtctcctgaccacgctcacaccaccccgtcgaccgccccggccagcgcctcgggcaccggcccgccagtcagccagtcggccagttcgacggtatgaatgaagcgggcttcgggcatatgcgcggcgatctgggtcaggcagcccagattgcccgccgccaccaccgccgccccggtgcggcgcaggttctgtgccttgcgggccccccagccgcccggccagttccggctggagcatgttataggtgccggcagagccgcagcagatatggggttcggccggctccagcggcgtgacgcccagccgtttcagcacctctttcggcaggtcgcggatcttctggccgtgctgcaatgaacaggcagcgtgataggcgaccggcagcccggccggcaggctgcgcaccggcgtcagatccagccccgccagcacctcggtcacgtcgcgggccagccccgccaccagccgggcccgatcggcataataggcgtcgcccgccagaagatggccgtaatccttgatcggcgtgccgcagccggatgtcgtgaccacgatggcgtccagcccgcccggctggtccgccagcgccgcccaggcggcgacattgcgccgggcctggtcccgcgcctgctccatcagccccatatgctgcaccagcgcaccgcagcacccggcctcgcgcgccaccaccacatcgaagccatggcgggtcagcacccggatggtcgcggcattgatccccggcgccagcacctgctgggcgcagccggccagcagcgccacccgcccccggcgggtaccttcggccggccagagctgcggccggtcggtggcagccggtgccggcacctcgtcgggcatcagcgccatcatggccttgagttcgggcctgaggccgcccagccagcggtcgagacccagccgtttcgcgatccgcccgccgatcagcgccgcccggaaccggcccggatagggcagcagccgggccagcaggccgcgcagcagccgttcgggcagtggccgggtataggtctccgccacccgcgcccgcgccatgtcggacaggtgcatgtaatccacgcccgacgggcaggtggtcatgcaggcgaagcagcccaggcagcggtcgatatggcgcacgacatccgccgtcgccggctcgtcgcgctccagcatacccttcatcatgtagatccggccgcgcgggctgtcgcgctcgtcgcccagttccagaaaggtcgggcaggtggcggtgcagaagccgcaatgcacgcagcgccgcaggatctgctcggcctcggcgatcgcggggtcggccaggcggtcgggggcgaaactggtcttcatgggcgggtctcctcgccgcgcatgcggccgggattcagcagacgaagcggatcgaaaccctggcgcacccgttccgacagggccgcgagcccgggcgcttcgggctcgaacaccggcacccgccggcgcaggggctcggggccgcgcatcagcgtggcatggccgccgccattgcgggcgaccagggcccgcagcgcggtcgctcccccgtcgtcaccggcctctgccggcaccgccagccagaccagcccgccgccccagtcgatgaagccgcgcgcgccgacacccgccaccgcatcatagagcagcgccgcgcctgcggccggcggcaccgacagccgccagaccacctcccgggactccggcgccaggatcggcacaacctcggcaatccaattccacaacttttggctgtgggccagatccagcaccgccgcgcagccgccaagcccgctctcttccgcccggccgacccggtcggccagcgcgccgtcgggaccttcgaagcgcaccagcagcgcaccgtcccgcgcatccggcagatcggcggcccgcgccagcgtcgacggcagccaggccagcgccgtcggctccagcggcccggcctgcagccgggccatggcggccaccgccggggccgccgccatcggcagcaccagggtgacggcatcttcgggcgcgggcagcaccttcaatgtcatctcggtcatgattgccagcgtgccgaagctgccggcgatcagcttgggcaggtcatagccggtgacgttcttgacgaccttcgccccggccttgaagcgttcgccgcgaccgctcaccgcttccagccccagaagatggtcgcgggcgctgccggcgcggatccgccgcgggccggccagccccgccgcaaccgtgccgcccagcgtcggcacggcaccggatgtgccgcaaagcgcggcaaggcccggcggctcgaaggccagcatctggccgcgcccggccagcagggccgccacctcggccagcggcgttgccggccgcgcggtcagcatcagctcttccggctgatagtccacgatgccggtcagcgcccccagatccagccgcgccgccgcctcgaccggccggcccagcccggccttgctgccgccggccaccacggccagactgcctccggccgcggccgatgcggccacgatctccaccagctcagccgcatcggcgggcctgaagctctctgtggtcatcggctcagaacctcggcagatgggcgtggggcagctgcccgtgatggacatgcatccggcccagctccgcgcaccgatgcagggtcgggaacaccttgcccgggttcagcagcccgtcggggtcgaaggcgcatttcagccgctgctgatgggccaggtcggtttcggtgaacatctcgctcatcagatcgcgcttttcgataccgacgccgtgttcgccggtcagcacgccgcccagccgcacgcaggccttcaggatttcggcgccgaaggcctcggcccgctccagctcgccgggcgcattggcatcgtacaggatcagcggatgcagattgccgtcgccggcatggaagacattggcgcagcgcagcccgtattcgcgcgtcagcccggaaatgatccccagcatctcgggcagccggccgcgcgggatggtgccgtccatgcagtaatagtcgggcgagatccgccccacggcagggaaggccgccttgcgtccggcccagaagcgctggcgttcggcctcgtcgcggctttcgcgcagactggtggcgccggccgcgcgcgcaatggcggcgacgcgggcgatcagcgcctccacctcgggccccggcccgtccagttcggcgatcagcagcgcctccacatccagcggatagccggcatcgcaaaaggcctccgccgcatggatcgcgtcgcggtccatcatctcgaggcccgcgggcacgatcccggccccgatgatttcggcgacgcaggcgccggcatcggccacctgcggaaagcccatcagcagggcgcgcacggtttcgggccgcggcagcagccgcaccgtcacctcggtcaccacccccagcaggccttccgatccggtcagcacgcccatcagatcatagccgccggcatccatatgccggccgcccagccggaccaccgtgccgtcgatcagcacgatctccagccccaggatgttgttggtggtgacgccatatttcaggcaatgcaccccgccggcattctcggcgacattgccgccgatcgaacaggcgatctggctcgacggatcgggcgcgtaatacagcccatgtgccgcgaccgcggtggtgatcgccaggttcggcactcccggctgcacaaccgcacagcgattggcgacgtccacatccagaatacggttgaaccgccccaggccgagcagcaccccgtcggccagcggcagcgcaccgcccgacaaagaggtcccggccccgcgcggcaccacccttatgccgcgccgggcgcagatcttcagcacccctgccacctcgtcggtcgtggccggcagcaccgcgaccatcggcttctgggcataggcggtcagcccgtcattctcgtagacctccagcccggtctggtcggcgatcacggcatcgcgtcccagcagggcgcggaattcggcgatcagctcgtctctctgggcaagggctgcggcttcgggggcgggcatgcgcatcgggtcgtctcctcgggtcgcgcggcgcgaggttgaacgcagagcagacatcatataccgcccgaccgatccggaaacgcgaaacgcttcagacgcaaaacggccgccgtcccgaaggacggcggccgtttcgaaagcgtcccccgggcacgatctcccgggatcatcgcaagtccggcgccgaaggctgccggccgatccgatggatcagccctggcggcacttcatgcgcgggttggacttgttgatgatgtaaacgcggcccttgcggcgcacgacgcggcagttcttgtcgcgcttcttggcgctcttcagggagttgatcaccttcatcggtctggtcctcgcgggttcacgcgccctcgggcactgccccgggctcctcctcaggcgaaaagtgcgcggaggatatcgatgccccctgcggctgtcaacgcggaagcgcggggttttgatcatgtcccgcggccgcatgcggccgcatcgtcgcccctgcccctggcgggccgtttcggccaggatcgaggccatgttcatccaaagcgtgggagccctgccgattgaccgggtccgaggtggaacgcagcgtcagcctctgtttgcgggccgcccggcttgccagtgaaaacagatggccgcagctgcgaacggttgcccatcgccaccgtgtgctccgcaaggcgcggcgactgatcgtcgtcgggcgcaccgttggcattcttctggacgacgaatgccggtcgaagggctcgcgcgcctccggggcgggaaagtatcgcgcggcaaagtaccgggcgggcgcccgcgaaagagcttccgaggacatcgcggccggccgcggggaggccagagaggattggccgccctggtatccgccggaaaatctgctctgtcatcccgaccatccggacgaggtcgtgccactctcacgcctgtcgcccatggactggtacagacacccggcagagctggtcatgcttcaccgctacttcctgttcaacggctggatctattcgggctggcgctatgtgatctgcagcccgctcgatcatccgggcaagatcgcgatcggctatgacacgatggcgccggtgaaggacacgcggagcgaggccggatggtgggcccggtgcccgcttgcagcacctgcatccgaggccgttcccgatcagatccgcccatccgaacaggaagagatacgtaccagaccggacgctcagcgcatctccgcaggtcctgtcgaccggacatggctctagcggccgacccgccgggcgtaaacgcgatacaccttcagatggccgcgttcgatcagcgtcgcgcgcgccgcccacatctcgatctctttcagcagcgcccggcggaagccgcgggtcatgttgccgccctccagccgtttggcgaagtccgcccagccgcggcggatcatccggtgaaccagttcgctgatgtcgtcgcggatgcgcacatccaggcgcagcgcctccatggtcgccagcgcatcgtccaggctccagggatccggcatcaccggctccaccgccgcccaggtccggagatccgggatcacatagccgctgctcggcagcatgtaatcggtgaacagcatctgcccggtctgcggcttcagcgcaccggccaggttgcggatcagctgtggcttgtcgggcatggtgaacagcgcttcccggctgatcaccgcgtcatagatgttctgcttaagcttgctttccccggcatcgaagcgctgcaccggcgccttgcggccaagtccggccttggtcgaatactcgttgccgcgttcggccagcagcgggtcgggctcgaaggcggtcacccaggcatcggtttgcctggtgatcgcacgcgccaccccgcccagccccgcgccgatatccagcacctgcatggaattgtccaggctcagcggccggatcagctcgtcgaccagctccgggccgccgggctggatgaagccttccccccacagatgttcggcgaccgtgatccggtccaccgtccacagcggccccttgcccttcttgccgatcacctgatcgtccgacggcggatcggggtccacccggttgatcagatccaggatcggcaaggccggcgtcggtgccggcagggcgagcaccggctgattgcgcccgcgccaccacgccaggaaccgctgccgcaatcccggccgcgtgggcttccgccgcgctgattgtcgcgccatgcgtcgcgtgatctccgtgcctgtcgttcgccccgtcccggccgcacccgcgcggccccgacagcatagacggcgaagggcggtccgctcaatcgcggaccgccccggaatgcatcagatgcaaggtaacggaccatccccccgtcacaacaccccgcgcccgcccccttcgtgcgggcgcaagccgccattgaggcggcggccaagggcatggaatgcccgcccggcgagggccaaatagactcccgccattgaagcggcggccaaggccacggagtgcccgcccggcgagggccaaatagactcccgccattgaggcggcggccaaggccacggagtgcccgcccggcgagggactaaaggactccaagggcacggcggcacccacccggcgaggggctaacaaaccctcaccccaggctcttcgccagctcttccttcttcaccttgccggtcgccgtcatcggcagggcgtcgacgatgcggatctcgggcaccttgtagaccgccatggccttgcggcaccaggcgtcgagcacatcagcggtgatgccctctgcgcggtcgggatcgagccggatgaaggcgaccggcacctcgcccttgtcggcatcggggcggccgatcacggcgctgccggcgatggccgggtgctggcccagcagcgtctcgatttccgacgggaagacgctcatgcccttgaccttcagcatctccttgcgccggcccagatagcggaacgatccgtcctcttcgatcacgccgatatcgccggtgcgcagccagccgtcgaccagcgcctgttcggtggcctcgggcttgttgagatagcccttgagcagagacggcgtgcggatcagcacctcgccctcggcgccgagcggcttcagctctccggtcgcgaaatcgcagatcttgacctcggtgccggggaccgggaagcccacgaagaccggggcggatttcaggtcgtaatcatccgtctgcatgccggtggtgaaggtgtccgaggtgtgggtctcggtcatgccgtacgaggtttcgcggagcgtgaggccggtcaattcgtgccagcggcggcggaattcggggttcagcttcttcacgaacgagatcgtggtcatggaccgcagcgacgagagatcgcgggcggtgatgtcgggccggtccatcagttcgacgatgttgtccatgatcatcgaaccgcggctgaccctgtagcgctcgatcgcggccagcaccgcatcgccgtcccagcgcgccagcagcaccatggtcgagccgctgaacaccggcagcagcacgcccagattctcgcccgcgatccagaacaccggcaggaagttcagcagcacgtcggtctcgtcgcccggcgacacgaagctcgccgaggcggccgaggtatagaccatgtcgcgctgggtgtggatgcagcccttgggcatgccggtggtgccgccggtgtagttgatcgcggcccaggcatccagatcggctttgtggtcggggcgcggaccggtctccgccgccagcacctccatgaagcggccatcggcgccggcgcagtcgcgcggagccgcgaacagcccggccggcaccggcagggtcggctcgccctcgggcgccatgtcggcgaaggcggtggtgtagaccgtcttcagcgctgttttggcccgcaccgcctcgaccagcggataaagctggtccagcaccacgatcaccttggcttcggtgtcgttcagctcgtaggcgagttccagttccttgaacatcgggttgaccggcacatggatgcagccggccttgaggatgccgtaaaaggcgatcaggaattgcgggcagttgggcaggaacacggcgacccggtcgcccggcaccaggccgagcgcggccagatgggcggcgaagcggtccgacagccggtccagatcgctgaagctgatctcgcggccatagaagatgatcgcggtcttgtcggggttggcggccgcgcggcggctcagatagtcggtgatcgcgatctcgcccagcgggtaatgcgcctggcgcggcagctccgccggccagcgatcctcgcggagcttcgccacatgggcgagataggcggcttcgtcagcgaagcccgacgatgtggcgggcgcagcggcggcggtggtcatggtccgggcgtctcctctctcgcgcgcgggccgcccgccgtctcccgctggggcctgcatgccccggtcttcggcagcggatccctgccccgcgcatgatcccaagtgaagcaccggccccgggctaattcaaacgtttatttgatcgcctccgatgcatcgctcatactttgcggacaacaagaacgaggaaacgttccatatgagctgggaagccgatatcgaggaactgcgccgtcgtcaggcgatgaccgcgcggatgggtggtgaagagaaggtcgcgcgccagcatgccaatggcaagctgacggtgcgggagcgcatcgacgccctgctggaccagggcagtttccgcgagatcggctcggtcgccggccgcggcagctatgatgccgagggccagctggtcgatctgtcgccggccaatttcgtcttcggccgcggccggatcgacggccggccggtggtggtgggcggcgacgatttcaccgtccgcggcggcgccgccgacgcctcgatccacgaaaagcaggtgcagtgcgaaaagctcgccggggaataccgccagccgctgatccgcctggtcgacggcaccggcggcggcgggtcggtgaaatcctacgagaccatcggccatacctatgtgcccgccaatcccggctgggaggtggtggtgcagaaccttgagaccatcccggtcgtggcgctggcgctgggctcggtggcggggctgggcgccgccaagacggtggcgagccattattcgctgatggtgaaggatatctcgcagatgttcatcgccggccccgcggtggtggcgcgcgccggcgaaagcctgaccaaggaagagctgggcggggcgatgatccacgccaaagccggcgcggtcgacgatgtggtcgacagcgaggccgaggcgttcgagcgcgcccgccgcttcctctcttacctgccgtcctcggtggacgaactgccgccccggatcgcgccgaccgatgatcccgagcgccgcgacgactggctgatcaaggcggtaccgaaggagcgccgccgggtctacgacatgcgccgggtcgtgaaatcggtggtcgaccagggcagtttcttcgagatgggcaagtggttcggccgctcggccatcaccggcctcgcccggatcgacggctggccggtggcggtgctggccagcgacccgcatttctacggcggcggctggacggccgacacggcgcagaaggtggtgcgcttcgtggaccttgccgacaccttccatctgccggtggtgcatctggtcgacatcccgggcttcctgatcgggctggatgccgagaagaccgccaccatccgccacggcgcccgggcgctgtcggcggtgtatcaggcgcgggtgccctggtgcacggtggtcatccgccgcgccttcggcgtggccggcgcggcgatgatgaaccatactcgcgcgcgctatcgctttgcctggccctcgggcgactggggctctctgcccatggaaggcggcatcgaggtggcctatcgcgccgaactggacaaggcgcctgaccgcgaggcggccatggccgaaatcaccgaacgcctggaaaaggtccgctcccccttccgcagcgccgaggctttttcgatcgaggagatcatcgacccccgcgacacccgcccgctgctctgcgaattcgcaaacctcgcggcgccgctgcgcaggccgggcttcagggcggccggcttccggccctgagcccacgggccgatccgccacggaagccccgccgggcggtggggcttccgtccatcggagtgttccggaatatttgcgcaattcgcgccgggatgctgttgtccggtggatgtcttttggtatcgcgaagaagaatgaggtcattgtccgccaccatccagagccccatatatttaagaccggcccccgaaagacgggacagatgacttgccggcagtccgggtgatttcagtgacgcgtgaagccgccacccccggtggaaagcgatgacgccggcggccggcgatgccggcggacacggccttcacatccccagggcggcccttgcgacgcagagcctttgccgatccctgaatccgatcacgggagagacgcatgggcgacggtgcagagctgagactggacgtaagacgcttccaggcgcccattttgcgcaaaagcctcttccaggccatcacctcgttcggcggcttcggggtgaccgcggccgcgatgtatctgtcagccggcgtgtcctactggctttccctggcactggcaccgcttgccgcgggttttctggtgcgcatcttcatcattcagcatgattgcggccatcgggcgttctttcaccatcgccgtgccaatgatcttctgggctttgcctgcagcctgctcaccctggccccctacgcctcgtggcgccatcagcatgccggccatcacggggtgtggaacaatctcgatcgccgggaaagcggtgccgacatctattcatcctgtctcaccgtcgccgaatatcacgaattgagcccgcggcggcgctggtggcaccgcacgacccgccacccgatcgtggcgaacattcttctgccgccgctggtcttcctggggctctacagggtgcccttcgacaccccgcgggcctggcggcgcgagcgcagggccgtctatgtcaccgacatcgtcctggtcgccctgttcggcgggctcggcctgctgctcggcttcggcgaggtcgcgagcgtgcagcttccgatcatgatattcgcatccatcatcggcgtatggttgttctccgtccagcatcgggccgcaacgacgcggtgggcacgccaggatgactgggatgccgtctcggcatcgctccagggatcgacctatctgcgtctgccggctgttcttcagtggttcaccgggaatatcggctaccaccacatccaccacctgaacccgcgcattccgaactaccggcttcaggaatgccatgagtcgatcccccggctgcgcgacgtgccgaccctctccctcagagacggcctcagcgccctgcgctatgcgctgtgggacgaggaccacggccggatggtgatgttccgggaggccgatcacatccccgccacgccaatgccggcggccggccccgcccccgcaacagcccggatcgcgcagagcggggactgatcagccgggatctcctccacagtcagacgcggcatcttgcgacggaaggtacggatccggtcatgcactgcgcggacaccctcgcgacgccccggaacctccaccgcagccccccatccggcgtaagcctgcccaccgtcttcagctgccgcatcggaatatccggaccatcgtccccgctttgctgccattgttcggtgtgaatctgaaggttccgggtcggtgggggcgatgtgatcgcagaatgtcagggtctgttcgatatcagggcaagaaccccctgcttgcggttcacccagcgggcagctaccgggctccgccaggcgatcagctcacgcaccatctcataatccgccacggtatccctggtgaaaatcggttcatggtgcgcgattcggttgcgaagggcgcggatcgcccgcaaatcgtcatatgctttcgcgcgagcaccggccacgccgagagcaggaggcgcgccaggaaaggatgtcgtaaagtgtgctttccagatgcggctatcctgcccggccgtgaaaatcttctcccagaacgcaaacttcagttcagccaccactttgccgaccgtcggttgccgcgcagccacggcccgaaggtccgattccggattatagtcagatgcccgtttgggacgcggcaggctccgtaagaagccgttcgaccagggccatgtggcaccgtggaccttctcgatggcttcggccacgccgttacgcacggcgacctcacaaatctggagtggcacgatgaatgcggctgacaggtccagattccattcatagagcgcgagcgcccgtgcccgatcgtttccagtggcctgcagataggttgcaaagcgcggcgctgatatgacacccggcaagtcatgcagttcggcaggcgtgaagaccatggcaggccccttcttgttcttgcagtccggaggagcgtagcctgaccaccggtccattgacttttggtatctaatgtcctaaattttaggacatcggctttgagaatgcgggcgaaagccccccctcatcgtcaatggcttacgatccaaaacccgccttacatggcgggttttgtgattcctgcctgaaggaaaggcgggtatctgcgttttcggaacatccggccccatggttgcggtcatgatggtgcgcgcaatataaccatggatagatttatcgcataaaatctgacacctgtctcagtcgtctatccagcactctttcggaattcagcacggcggtaccggtcttcgaacacgcttttcagcgccgccgccgctccatcacccccacaatccccgccagcagttccacatcttcttccggcaacagcttcaccccgttgagaaccttcagggcgctgtcggacagcgtctgcagttcgccgggggcgggcagggtgtcgaggaagaagtcggcgatccgcacgttcaggatgcgggcgagctggtcgagcgtgcggatgctggtgatcacccggccgcgttcgaaatttgagatggtttcgacgttcttgcgcatcaattgggcaagctgcgcctgcgtcagaccgcgggcttcgcggaacgctctgatgcgtgtgccgatgtgaatgccgatgtccatgggcccgatcctgcggacaaagccatcggctgaccatctgcgtaattcacggggtattttaccctatgtaattttaggatatgggtggcgtccggcgtgtggtggccgaacggatcaactggggatggggctgggggcatggcgacaggaaatccgcagggcgaacgcagatcgggcaggtggttggtagccatggcggcggcggggatcgccctcaccctcccaccccccgcccatgccgcctggcagcgtctgccgactgaacttgtccctttcgacccggcgccgccgggcggtggtgcggggggtgcggcgcggccggtctggtatctggcggccgaggggcgggagagtgtgctggtcgccagctgccgcgccggcggcgggccggtgctgtattgggtggcactggccggcgccgcccgcgccggtgggcgggtgccgccgggggtggcggcgctggaggtggtgtggcgggtgggggatgggcccgcccagaacggcatctgttgggccggccccacgcccgacatgctgcgccccgaaggcgagagcggctggccggcgagacgcggttcgagatgcatggcgcccggctgcccgtgcagcgtttcgacgtcaccggcaccgcgagcgtggtcaccgatgtggtgacggcctgcctgccggttcgcgccgccccgcctgtatccgattgagggagggagcgtggccggggtcagccctggcccgcccgtcccgcccagaattccgcccccggaaaccgccccgccgcctgggcgtaataggcggcaaggcggccgcgatacacggcgcgcaggcgcgcctgcgccgtcaccacctgaggaatggcgctgctgtcgccgcccagcgccgcatccaccgcgcgcgccgcctggcgcccggcatgcagggccgagagcaggccctgggccgagagcggatcataggcctgggcggcatcgccggctgcgatccagccgggacccgccagccggtccagcgccgtgccgccggcatcgcaggccgccacctgatcgagagccgcaccggcatcggcatggccggtcaggcgggccagatggggggcggccagtcgggccgcatgccagcgcggccggtcggccagaatgcgcgccgccgtggccgggctggtgtgcagcgccgccatcaccgcgcccgacggcagccgtgccgcataccaccagccttcaggcaccgcctcgatcaccgtgcggtcgaagcccggatcggccatcggcccctcggtgacggagagccgcgcgaagatcgcgatcagccggtcgtcgcgcagccggccggcgcccagttggcgggccagcgccgcccgccgtccggtggcgtcgatcagccagcgcgcccgcaccggcggcccgcgatcggagaaatcgacccgccagaggggggccgtatccggcgccgcatccccgctctcccgccggaccgccaccacccgcgcccggcgtcggccggcgccggcatcgatcgccgcctggcgcagcgccgcgtcgaaggccggccggtccagccgccagccggggccgtcggggctgcgcaggaaatcggtcgcctccagctccgccgtggcccaggccgaccagctgccacggacgtgggtgtgccgttccggatcgggcggcggcaggccggcggcgcgaaagaagccggccgccgccccgggcagggcctcgccgatcttcgtatcatgcgcatcggcatgcgggcggcccggatcggcgatcatcgcccggcgcccggccatggccagcgcatgggccgccaccgcgcccgccgggccgccgcccgcgatcagcacatcgaccacgcggccggcgggtgcggccggccgtgcgggatggccgtcagcggcgtctgtcggtgtggcggacacggatcgaccggaactcctccatctgggcctcgctttcccagccggcacggcgggcgtcgctgtcgggccccatcgccggggcggcagcggcaaaagcggccttcatcagcgcggccccgcggctttccacgaagatcaccggtggcagatcgggatcatcctgcacgcccgggcgcgcctcgacaatgccctgggcgccgaagcgggcgatcatctggtccatcacatcggcaacgctgccggtgaaaccgcgcatccagctggcccggcgctggaaggccgccacccgctggccatgcggcaggtcttcgttcatcacggtctgatagtcttccgccgtcagcacctggttcggcacccgcgccggccagaaggacggcagatacgggtcgtaggcggcatcatagcccgaccggcagaaggccgtgtcgccctgccagggcagcgccatccagcgcgtcacatcccccggcgcctgggcatagaccggcccgccggggctgagcgccaccgcctgggtcagttccttgccgtaatcctgctcgggctggccggccgggcgatggcgcaggcgatagggcgcctgatacatgctgccatggcgcatcggccaggtgacctcgcagcccggatggaaggcatcggcgatgcagaaatgcagggccgccttgtcgagcatcgccggctggtcttccagcggcacctgatcgatgacctgcgggggcggacccgagggccggtcgtcggtgaaccgcccctcgacccacatttccatcagcgccgcccgggtgaccgacatcggcagatagttgttcggatcatcggactggaacgagccgtaggcgtcgccatagagccagggccagacgctgggctcgcaggcgatggtgtggggcgcgcggaaggcgttgtagatgttccgccgcagctccatccacgggtcgtcgccgcccgcgggcggggtcgccagcctgtcgatcagggcgggatcggtgaaatccatcggcccgccggcgccgaacagcccggcaaagcccttgttcacccattgcaggccggtcagccgttccagcaccggctggatgtcgcgggcgaaggaggcgatatccggcatcggcagccggccgctttcgatataggtgtcggtcaacaggtcgtggagcgtgcgccaggaaatcacgtccggcgcataattcggcggcgccaccaccacccaggccggttccaccggcagcggccggccatccagcaccaccgccgccgtcaccggcccgtcggaggtgtcgtcgtaccagtcgtcggcattgttgaagctgttcggatcctcgggccggtagaccggcgcccccgagggcgaggccgaggccccgcgcccgcccaggaacagcagccgcccggcatcgtcggtccggatctcgcccagcggcaccaccgtgtccttgaatttgccggtgtcgaaggcatggtcggcgccgcccgacacatccgcgccggaaatgctgcgcgggccgggatcgatcaccaggatgccgcgctgggcaaagggcacgtcggggttgcggcgcggcaccgccatggtcgccgcctcggggatgtccagcgccgcctggaactggtaccaggccgccttgcggttcaccggatgcaccgtccaggtgatgtcggcatccgccgcggtcagctcgcgcaccacccggccctcggcgtcgaggccataaatgcggaaccgcgccgcctgccgcttcagcgcgccggcctcgtcgcgataaaaaccgggctcttcaggctgcggtgtggtcacttcagggccgatgtaatacgccgtggcggcatcgccgattcgcgccaccccgatcgccgggtggatcgccgcgcgcacgatttcaccggggaccgcgcccccaccgatttccgccatatcctctgcctccctctccgccggtcccgctcgcgagacttcttcggcacatgatgccagcggccctcccggaatgcatcggatactttcgtgaagcgcgcacgaagtcacagccatgcagcttgcggacgaaacgaaaaccgccgcagccggggcaggctgcggcggtcgagtcggctatgactgtatgtccagggaggagaaggccggaccttacacggggggggcatagccgaaagcgggcacggcgctggcggcggtctcgacccagacgctcttcacccgcacatattccagcaggccttcatagccgctggagcggccatagccgctctcgccgaagccgccgaagggcgacatcacgccgatggtcttgtagccgttgatccagaaggtgccggccttcaccgccgccgccacccggtgcgcccggccgacatcctgcgtccagaccgcgccggccaggccgaaacggctgtcattggcgatcgccaccgcctcggcctcgtcgtcgaaggggatcaccgagaccaccggcccgaagatctcttcgcgcgccacctccatgctgttggcgacgccggccagcacggtcggggcatagaagaaaccgtcttccagcccgccaccggcaagccccgccggccgcccggcgccggccgcggcctgcgccccttcggccaggccgcgggcgaccagttcaccgatccgggcatgctgggcaccactcacgatcgggccgatctgggttgccgggtccagcggatcgccgatcgggatcctgccggccgcctcggccagccgcgccaccacccggtcatgcacccgccggtcgaccagcaggcgcgagcccgccacgcaggactggccggcgcccgagaagatcgccgcctgggcgcccagaaccgcccggtccagatcggcatcggcgaagacgatattggctgacttcccgcccagttccagaacgcagggcaccacccgcgccgccgcctgcgccgcgatgcgggcaccggttgcgggcgagcccacgaacaccaccttcgcacaggccgggtgcgcgatcgccgctgccccgacggtgtggccggcgccgatcagcacgttcacggcccccgccggcacgccggcttcggtgatcaccgcccccagcgccaccgaggtcagcggcgtcagctccgacggcttcagcagcacggcattgcccgtcgccagcgccggggccagctgccagccggcggtgaagatcggcgcattccagggcgtgatctgcaccaccacgccatagggctcgtagcgggtatagttcagatggctggtcggcacggggatgaccgcgccatgcagcttgtcggcccagccggcataatattcgaacatctcggcgaccttggtcgcctcggcacgggtgtcgcgcagcggcttgccggcagtcaggctttccagccgggcgaaatcctcgatccgcgcccgcaccgcctgggccgccgcccagagcacccggccgcgcgcggcatgggtcaggccggcccaggcggcctgaccggccgtggctgcggccgccgcctcgtccaccagtgccgcaccgccatcggccaggctcagcacaaggcggccggttgcggggtcgatcaggggcagcgcctcgccttcgccatcgaccacccggccgtcgacgaagctgccgatccggtcggaaccggtcagccgggcaaagatggcgcggatttcggccgtgctgtcggccgggcgatgggcagtcatctcggtcatctctcgggctcccgggtcagtcgagtgcggcgatgcggttgaaatcctcgccatcggccaggtcggcggcactctcgcgccagaggcggccggccacttccagaagcggcatggcctggccggtctccgccgccagcgcttcggccaggcgcacatccttgcgcatcagccccatggtgaagccgctgtcgaagctgcccgacaggatccagcgcgggaagttcacctccgacacgccggcccggcccgatccggcattcagcgcaccgaccagggtttcggcatcgacaccggcggcgacgcccatccgcaccgcttccgacacggtcagcaggtgcgcggcgcagagcaggttgttgaccagcttgaccacatggccggcccccaccgcgccacagagcgagatcttcgccgacagcgcttccagcaccggccgggcgcggtcgatatcggccgccgcaccgccgaccatcatggtcagcgtgccggccgccgcccccgccggtccgcccgagaccggggcgtcgaccagggcatggccggccgccgccagtgccgccgccagccgccgggtcacggcgggctcggacgtcgtggtgtcgatcaccagccggccggtcagatcagcggccgccagcaggccgccctcccccgccagcaccgcctccacatgcgccgccatcggcagcgacagcacggcgatgtctgcggcggcaaaggccgcggccgggctcgccgccagcgcgatgccggccgcgcgggcgcggtctccggcatccggcgccggatcatagccggtgaccgcgaagccggccctggccagcgtggccgccatggcggcgcccatattgccgaggccgatgacggcgacccgtcggtcggtcatgtcgtcactcctgaaatctcgatggcgggggagaagaaccgatggccgggccggccatgacttggccggccggcctcatgatcttgcgcggacatccgggcgggggatgttttccggctgtccgccccccgaaaatgagcgcgcgcccgcccccgctcaagcgctattgccggaacggcgcgttgccgttatggcaacggatggcgacgggtttcgtcacccggccggcaaccatgcatgccggtcgcgacaggatcaggagaacggggatcatgctgcggatcgacgacaagccgctgcgctatttcctggcggtgttcgaagcgggctcgatccgggcggccgccgacggtctgcacatcgcgccctcggcgatcagccgtcaggtggcggggctcgaagccgatctgggcgtgctgctgatggagcgcaccaaacagggcatccgcttcaccgaagccggccgcctggtcgccggccatgcccgccgccggctggaactcgacgacggtttcgcggccgaactcgccgccgccaagggcggcatcgccggccgggtgcatgtcatcaccggcgagggcttcgtggtcgacctcatgcaccacgcggtctcggcgctggcccgcacctatcccgaggtgcagctctcgatcgatgtcggcggcaccgaccggatgatgcagggcatcctgaaggacgcctatgatatcggcctggtcttcaacccgccgcgcctgcccgaactcgacgtgctggccgaggccgacaagccgctctgcgtgctggtcccgcccggccacccgcttgccggccgcgacagctgccagctggccgaaaccctcgatcagccggcggcactgctcgccgaaaccttcggcgtccgcaagctgatcgcaggcgcagaggcggcctcgggcctgcgcatccggcccaaactcgtcaccgactcgatcaacgtcgccatgcatttcgtgctcggcggcgccggcatcacctatctgccggccttcgccgtctcccgccagctccgccgcggcgaggtccacgccatcccgctcgccgacgcccccctcgcccacgtcccctcgcgcatcgtcgtccgctccggccgcccccgcaccggcgccgtccgcgccgtcgccgacctgatggcccgccacatggaagccttcggggcggaagcggggtgatgccaggggcctgccgcagatcccctgctaaatctcccgacggatactcctggatggcctcatacgctcgtgctcacacctggacacgtgtccgacatggccggagcggatctgctgctgcccgggatgccgaaaacccgctacctcattgcggacaagggctatgacgccgaggtgtggcggcacttgatgggctcctgaagcctcttatgcttcaatcaacctccgtatcgtcgccatcggcaggaacagccgccggctctcgcccatgaacgagatgaacccatacttacgatagaacgcggcggcagcgtcgtctttcgcatcgacgaccaccgcgtggactgcaagggtctgcgtcgcgagcaggatacggttcagggcatccatgagcaggaaggctccgagacccttgcccctcatgccgtcatcgacggccagtcggccgagcagggcagccggtacggggtaacctggcaggcgcttcgcctggccggccgggaggttatcccgtcgaaagctggtggcgctcgggctgtagtagccgcagaccgtcagcgtcccggcaggcatggccacaaacaaagacgcgggcgacatcccgcttcacgtcctgcgaagcatgttcgcgaatgtaacggtcgcgttcaggagcaccacacgagaaggccgaccgatcgtggcccctgctatcgcgcggcgcaatctgccatggcgcatgggcgtgcctcatccggtcgccttcttgtacctggcgaaggcctcgcgcaaggccgcatcaggcgccggcgggttggtcagcgcgtcgtagaacaccgtccaatccgggccggacagggtgacgatctcgttctctcggatgactttccgggcttcctccagcgccgtcgcgaggacgaactggctgactgtcttgtgccggtagctggccgcgcgctggagcaggctcttcgactccgcgtcgaggcgcagctgcagccggtcatccccggtgtccgccgcgcggagcatggccattctccttatccgaacgctccctataccgtgctcacgaatggagcatatttcaaaggatatgttcggagcagccggctatagctcgtcgtccgcgccggctcactgtcgaaacggtctgccccccaaccctcacccccccgccacccgcaccgcctcggcatgcatcagccccaggatccgcttcttccagcccatgaagtcccccgtggtcagggcgtcgatgccgcgcgggcggggcaggtcgatcaccatggacgaccggatgcgcccggggcgcgcgctcatcacatggacctcgtcgcccagcaggatcgcttcgtcgatgtcgtgggtgatgaacagcacggtcttgcggcgctgctgccagatctccagcagcagttcctgcatcacctggcgggtctggctgtccagcgcgccgaagggttcgtccatcagcaggatgcgcgggtcgttggccagcgcccgggcaagcgccacgcgctggcgcatgccgcccgacagttccgtcggataggcgtcgccgaagccggtcaggtgcaccgcttcgatcagctcgtcggcgatggcggcgcgggccgcgcgggacatgccgtccagcttcggcccgaacatcacgttctcgcgcaccgtcagccaggggaacagggtatagctctggaacaccatcccccgctcccgcgaggggccgtcgatcgggcgtccgtccagggtgatccggccgtcatccgggcgttccagcccggccaccaatctcagcagggtggatttgccgcagcccgaggggccgacgatcaccgagaaggtatccgggcgcacggtcagcgacacatcgtccagcgccaccaccgggggcttgccgcgggtctggaagcggacggacacatccgcgatgtcaagcaggctcataggggtcaccacccgatcggaagcgcaggaagggccaggtcggcggaagggggccgggtcagaggccggcggcccagggcagcaggcgccggcgcagccatttgaacagggcgtcggtgatcagccccaacagcccgatggtcagcacgcccagcaggatcacatcggtgaacaggccgcgcatggcgttcaggatcatgtagccgagcccgctatcggccgcgaccagctcggccaccaccagataggtccaggcccagcccatggtgacgcgcagattgtccatcaccccgggcaggcaggcgggcaccagcacctggcgcaccacctggccgcggctggcgcccagcgtataggcgcagtcgaccagatcccggctcacccgcgccgagacgtccgagatcaggatcagctgctgaaagaaggtgccgaggaagatcaccatgatcttctgctccaccccgatgccgatccacagaatcagcagcgggatcagggccgagatcgggatgtagcgcatgaagccggtcaccggctctaccagcgcctgcaccgccgggaaactgcccatcagaatgccgatcggcaccgccagcaccgaggccagaaggaagcccgccagaatcacctgcaggctggcggcgatatggccgaacagcgacaggttcaggatccgctccagccccgcccccagcacctggccgggggtggccagaaagtcgggcggggtcaacccgccataggtgagcccgcaccagagcccggcgatggccagcaccgatgcggtgccgaggcccagagaggtgctgcgcggcagcgaaatcttgggcgaaaacagcgttctggtccacatgggtaccggcccttcgctcacgctcagtcaaccacgccggtcgcgatcatccgggccggttcggccgccgccctgaacagccccgccgcctcgcccaggctcttcgccatggtgatggtggcaagaatgccgtccggattggccgggtccatgaagcggcggttcatgtcggcatcgtagaaggcgatgccggcgcgggtttcggcaaagaccgcggggtcttccagccagccgcccacacctttggccatgatccggtcggcctcggcctcgtgggtcttctgccagtcgaccgcggcagtccaggcccgatagagcgcctgcagcgccggccggcgcgcctccagcgtcggcaccgtggtgaccatcacatcggtgatcagccccggccggctggcgctgtccgccagcaccgcgccatggggtgtcgccttgccgcggctcagccacggttcccaggtcaccgccgcatccacccgcccggccacgaaggccgccccggcatcgccggcggtcatgttgcggctgtcgatatcggccagcgtcagcccggcatccttcagcagcacgctcaggaagaactgcgacaccgagccttcggtataggcgaccgtgcgccccttcagcccggcgaccgaggtgatctcgcgccgggcgacgatgccgtcgccgccgcggctgtcgtcgatcgcgaacagataggtcagcggccgttcggtcgtcgaaaagcccagcaccgtgtcgatggtggtgaccgcggcatcgacccggccggcggccagcgccggcatgcgggtcttcacgtcctccatcatcaccagatcgacctccagcccttccttcgcgaagaagccctggtcgcgggcgatgaacagcgggccgtaaccgacccaggtggacagcgcgagtttgagcttttcagccgcgccggccggtgcgccggcaccgaagacgagcgcgaggccaagagcggcggcgccgaggcgggaacggatccgcatgggcatgggcgatcctccggatcagggtgatgaggggcgcagacgatcagccggcgcggccgcggagcgcgggcgacacggcaagcagacagagcagttcgaacatcagcgaggcgccgacccaggcggtgccgccggccgggtcgaagggcggcgagacctccaccagatccgcgccgatcagattgagcccggcgagcgcgcgcagcatgcgctgcgcctctcgcgtggtcaggccgccgatttcgggcgtgccggtgccgggcgcgaaggcggggtccaggcagtcgatgtcgaaggtcaggtaagtgggggccgtgccggcgatcgcccgggcttcggccatcacatcgtccatgccgcgggcctcgcactcctcgatgcggatgatccgcaccccctgcgccagcccccaggcaacgtcggatccgtcgtacatcgtgccgcggatgccgatctgcaccacccgtttcgggtcgaccagcccctcttcgatggcccggcggaagggcgtgccgtgggtgtagcggaagccgccgaaatagtcgtggaacaggtcggtatgggcgtcgaaatggatcagccccaccgggccgtcggcggccagcgccttcaggatcggataggacatcagatggtcgccgccggccgacagcggcaggatgccgcgccgcttcacccgctcatagaagccggtgatccgctgcagcgtgtccatcagatcggccgggttgaccggcacatcgcccagatcggccaccgccgcccgggcataggggtcgtcgcctgtcgccggatgcagggggcgcagcatgcacgacaggtcgcgcagctgacgggggccgtggcgggcgcccggccggttggtggtgccgccgtcccaaggcacgcccagaatgccgatctccaccgccgccgccgcggccgcgtcgatatcgaccagcggcaggcgcatgaagctggcggggccggcatagcgcggcacgtcgaaggcggagacgggccggaaggcgggggcaggcgcggggggcgcggcgggactggtatcgggcatggaacggggctccggagaggggctgctccggtcaggttgtcatggggagacacgtccaataagatcgaagtacaaaacttcacgtccggattttgcgacgcatcatgtccctgcacgttccgccgctcagcgatgtcgatctgcgccagctgcgcatcttccggtctgtggtcgaaaatggcggcttcacgccggcgcaggccgaactcggcatctcccgctccacgatcagcgcccagatggcggcattggaaacccggctcggtctcaccctctgccggcgcggccggtcgggtttcgcgctcaccgaccacggccagaaggtctatgccgaaacgatcaaatgctttgcagccctcgacaatttccgcagcgaggtgggggtgatgcgcggccggctggtgggcgaactccgcatcggcacggtcgatgcggtggtcgaaaacccgcgctgcgcgctcgatgccgccatcgccgccttcaaccaggcggtgcccgacgtccatgtcaccctgaccgtggtgtcgcccaaccagatcgaaagcgcgctgctcaaccggcagatggaaatcgccatcgtgccgaaccagccgatgaatgctgcggtgcaacttcagcagcttttccacgaggaacagaacctctattgcggcgcccgccatccgcttttcggggcagaggcgaagcagctcaccctcgaccggctgggcgcccaggctcatgcccggcgcggctacgccatcgccaccggctatggcacgctcttcgccgacccgccggccgccaccgcctattccatggaaggtctggcgcatctggtgttgagtggccggttcgtcagcttcctgccccgccattatgccgcgcaatgggtggacaccggccgcatgcgggcgctgcgccccgatctggtcagtttcggcgtggcactctgcgccgcccatttcccggtgccggcgctctccgaaatcgcccgggtcttccgccagcacctgatcgaggcccatcgcgggtgacatgcgctgttgccgtcccggcaggaggttccctgttgccgtcccggcaacggcagcgtctctttaaagcgcttgccgccaccggccacagttttgattctggcgggatgaacgggggtctgcgtccggggagtggcgcccctccgtcaaataacgtgtcgaccttgggaaggttcacgtctcacctccagccaatcggggggacgcttcatgtccgtcatcaaagaaacgatgcagctctggcggctgcatcttgccgtgctcgtgctggcgatcatcgccgagctgatcggcatccagcgcatcccgatcgggatcggcgcgatcctgctgctgccgctgctctacgccttcgtcatggcggcgctcatgaacccgaacatcgtgaagccggcgggcaagctgatccgctcgcgcgaggtcaaggccgcctcgccgctgatcgtgatcgcgatcatgccgttcatcgccaagttcggcaccaccatcggcccggcgatcgacaagatcatcgcggcgggccctgccctgctgctgcaggaactgggcaatctcggcaccgtgctgatcgccttcccgatcgcggtctgggtgctgggcctcggccgcgaggcgatcggcgccaccttctcgatcgcgcgcgaacccaacatcgcgatcatcgccgaccgctacacgctgaaatcccccgaaggcaccggcgtgatgggcgtctacgtcatcggcacgctgttcggcaccttcgtcttcgcggtgctggcctcgatcttcgccaccgccgacatttttgatccgcgctcgctcgccatggcctgcggcgtcggttcgggctcgatgatggccgcctgctcgggcgcgcttgcaaccgcgctgcccgagatgaaggacgagctgctggccttggccggcgcctccaacctgctcacctatgcgaccggcctttatgccggcctgttcatcgccctgccgctggtcgaaaagctctacaacgcgacccgcggccggcacgaaaccgcggcccgcgccgctgccggggagtaaggtccatgtcgaacaccgtctacaccgacggcaccctcaacgtcccggccgagccggacgagcgcaagctcaaccttctggaccatgccctggtcctgatcgtggtctgcgccatcgacctggtggtcaacgcggtcaatcacgaggtcggcttcctgcacaacctcaccggcatcgcggtgctttatgcgatctgcctggcgggtctggtgctgaccaagatcatgcccttctacctgccgagcgtcgcctggatctcgctggtcggcatggccgtcaccctgcccttcaccccgggttccgcctgggttctggaccaagtgaaggcgatcgacttcctggcgctcaccacccccaccctcgcctatgccggcttcgccatcgcgcgcgaagagatcctgaccgcgaagaaatccggctggaagctggccctggtcgcggtgctggtcttcttcggcacctatctgggctcggtgctggttgccgagctgatgctcgcctggacctgaccggcctcccatatccacctgaacgacacgccaaacccgtgcgcggtgcctggggcatcctctccccggcgccgcgccgtccggatggaccagcgcccccatgtcgctcagccttttcgacctgttcaagatcggtatcggcccctccagctcgcacaccgtcgggccgatggtcgccgcccgccgcttcctttccgggctcgatgccgccggccgcttcgatgcgctggccgcggtcacggtcgagatctacggttcgctcgccctcaccggccgcggccatgccaccgacaccgcgatcatcctggggcttgccggcgaaacccccgatggtgtggagcccgatgccatcaccggcatcgtcgaaggcgtgcgcctgtcgaagcgcctcgcggcactcggccgcaggctgatcgccttcgatcccgagaccgatctggtctggcgcatgggcgataccctgccccaccacaccaacggcctgcacttcactgcccgcgacggcgcgggtgccgtgcttgcggccgaaagcttctattcgatcggcggcggtttcgtggtctcgggcgccgagaccgaggcccgggccggcgatgcgcccgtccatggcgaccgtggccccctgccccatcccttcacgaccggcgccgatctgatcgcgctcaccgaagcgaccggcctctccatcgccgacatcgtccggcagaacgagcacgccctctgggggccggccgagaccacccgccggcttgaggcgatcaaggccgcgatgctgggggcggtcgaccgcggccttgccaccgacggtgcgctgcccggccggctgacccgccgccgcgccgccgatctcgcccgcaggctcgccgagcgcgccggcgccaacacgctccccgccctcgacgggttcgagcggctgtcggcctatgcgatcgcggtcaatgaagagaatgccgccggcggccgcatcgtcaccgcgcccaccaatggtgccgccggcatcgtgccggcggtgctggcctggctgctccgccattccggcaccggcagcgaggccgcggccgacaccctgctcttcaccgccgcggcgatcggcatgctctacaagctcaacgcctcgatctccggcgccgaggtcggctgccagggagaggtcggcgtcgccagttccatggccgcgggcggccttgccgccgccctcggcggcacgcccgcacaggtcgagaacgccgctgagatcgccatggaacaccatctgggcatgacctgcgatccggtcgccggcctggtccagatcccctgcatcgaacgcaacgccatgggggccgtcaaggcggtgaacgccgcccttctggcgctcgccggcgacggccgccacgtggtctcgctcgacacggtgatccggaccatgaaagagaccggccacgacatgcagagcaaatacaaggaaaccagcctgggcggcctggccgtcaacgtgccggtctgctgaccagcggacggatgcctccccaacgcgggccacaaaaaccagaggacgccgatccagatgccggacaacaatgctccccgcaacgacgtcgccatcgatcccgccgttgcggccatcgccgccgagatgcgcggctggcgccaccatctccacgcccatcccgaaaccgccttcgaagagcacgagaccgcggctttcgtcgcgggcaagcttgccgggttcggcatcgaggttacgaccggcatcggccgcaccggtgtggtcggcaccattcatggtcgccagggtgccggccccgcgattgcgctccgcgccgacatggatgcgctgcacgtgaccgaggtcaacgacttcgcccaccgctcgcgtcatcccggccgcatgcatgcctgcggtcatgacggccacaccgccatgctgctgggtgctgccaaagtgctggcggcggatcccgatttcgccggcaccgtccatctgatcttccagcccgcggaagagaacgagggcggcggccgggcgatggtcgaagacgggctcttcacccgcttcccggccgacatggtcttcggcatgcacaactggccgggcctggcgctcggccggatggcgatggcgccggggccgatgatggccgggttcgacattttcgaaatcaccatccgcggccgcggctgccatgccgccatgcccgatctgggccgcgatgcggtgacggcggcggcccatctggtcacccagctgcagaccattccgggccggtcgatcaacccgctcgacggcgcggtggtctctgtcacccagatccatggcggcgacacctggaacgtgatccccgagacgatcgtgatccgcggcaccgcgcgcagcttccggcccgaggttcaggcggtgatcgaacgccgcctcgccaccctggtggaacattcggccgccgcgcacgagtgcacgggcgagctgcgctatgagcgccgctatcccgccaccatcaacaccgccaccgaaaccgcgctcgcggcaaccgccgcggcgagggtggtcggcgaggccgccatcgaccacagccccaccccctcaatggcctcggaagacttcgccttcatgctgggcgaaaagcccggctgctatgtctggctcggcaacggcccgaccgagggcggctgcctgctccacaacccggcctacgacttcaacgacgatgccgccccgatcggcgccagctggtgggtgcagctggtccgcaccgtgctcgccggctgaagacccgtccgggcctaccccgccgcctccccccggccccgctccaactcgcggatcacgtattcgcgcagccgctgggccggggggccgatatcggcggccaccagcagcgccatctcagtatcggccaaggccggcagcccggcctcttcatccagcatcaccagatccgccggcaccatgtccttgggcagcaccgtcacccccagcccggcgcgcaccgcggcatgggtgccggtcagcgcgccgcaggtataggcgatccgccagggccggcccgccgtatccagcgcatcggtcgcgcgcttgcgatagacgcagggcgccggcgacaccgccagcggcaggggcccctggcgcatcgccaccccgcgttcggccgccacccagaccagcggctcgcgccagacccgggtgccgagcagcggcgcgctcggctcgcgcttcaccagggccagatccagatcgccggccgcgaagcggtcgaacaggttcagcgtcagatcgcaggtgacctccagccccaccgccggatgttcctgggcaaagcgcgccagcaccccgggcagatggctggtcgcgaaatcctcgggcgcccccagccgtaccaggcccgcaatctcgggctggcgcacccggtccatcagttcgtcgttcagcgccaggatccggcgggcatagtcgacgatcacctggccttcgccggtcagccgcacatggcgggggccgcgctccagcagcaccgctcccaccctctcttccagccgcttgatctgcagcgaaatggtggactggttgcgcagcagccggtcggcggcgcgggaaaacccgcccgcatcggccacggtcaccagcgtgcgcagcaggtcgacatccaggtttacgggtgcagccattgccatcctcaatatttaccatcgcaatggaaaggcatcgaattatcaatttctcaaaagacatggtgcggggcagcatagggtcaagccggcatcatccgggccggcgacgcctgagcggagcggaggcgcgcccatgactgaccagaccccccatcggccccgacccggcccccggcatggttggaccaaccagccgatcagcatcgttttcggcgacggcatcggccccgaggtgatgcaggcgagcctcaggatcctgcttgcggccggcgcgcgcatcgcggtggaaccggtggatctgagcggccgccccggggatgcggaggaagatcatgcccggctgctctcggccgcccggcagagcctgcgccgcaccggcgtgctctaccgcgccccggtcaccacgccgccggccggggtggcctgcccggtgcaggtgctcagccgcgatgccgatctcttcgccaccacccgcccctgccgggccatggcgccggccatcgccacccgccacccggcgatggatctgatcatcgttcacgacctgcccggggcggcccggggcgatgcccggcagatgcgggccgagcggcttctgcaccatgcctttgcggtggcgcgccggcaggggcttcgccggctcgatgccttcgtcgaacatccggatgcgctgacggcagagctgttcgatgccgtcgccggccattatcccgacatcgccgccggccgccggcgccttgaaaccggtctggccgggctggtcgatcgtccgaacggctttggtgtcgtggtcgtgccgggccgccatggcgatctggtggcgacgctcgccgcccgccttgccggcggcgtggggcttgccccctcggccgcgctcggcaccgattgcgccatgttctcaaccgtgcacggcacggcgccacagctggccgggcgcgaccgggccaacccgtcggccatgctgctcgcgggcgtgatgatgctgcaccatatcggccagcatcgggttgcagaatgcgtccacgatgcctggctcgccaccatcgaagacggcatccacactgccgacatgatcaatccgggcaccacccgcctgcgcccgggcacccgcggcttcgccgatgcggtgatcacccgcctgggtcaggccccgcggatgctccgcccggcggcggcggcgagcccgcaccacaaccaaaacattatgatgaaggcctgatcatcacccattgatggcattttgggacagtgccattctggtcaccatcgaccagacgggggaaggcccatgctcgatccgatgaaggtgccgcaaggcggctacaaccaggaataccgtcagcatcccaaattccccggcggctacatatacagccatgccggcggcgattacgatgcctggatgaacgcggtctatccactgctgcccgatcgggtcgccttcggcgatcccgatgcgcccgcagccctggtgaaggatgaacccggcaccaatggcgtgccgcagacggcggtgctctacccctatcccggcacgccccaggcgggtacgccctgggccttcaccctgatggcagggcgggctgcgatcgattttctgctcatcgcccgcatcctgttcattcagccggttttgaaccccgacggcacggccagcgcctggtcgtcggggctgatcgagcgtcacaccgaaaccacgctgctggccggcaacacactcaccgaactggtcggcgaccagggcgatcgctacgccctggtcgcctcctttcccggcgccgacatcgacgatctgccgccgcccccgcccggctacagctatgataagaagccgctggaccaggatttcaccctggtctgccgccgcttcgcccatatcctgatcaccgacggctacaacttccagcgctgggaccagggcaacgcgccggattgaccggctcagacgcgagcgatcgccgcgacatactcgtccaccacctgcttcagcgcccgggtctggccggccagctcgccagcggcggtgttcatctccgccgctgcatggccggtctggccggcggcatcggcgatgcccgagatcgcgcgcagcacttccgacgtgccggccgatgcctgctgagtgttgcgggcgatttccgcggtcgccgatacctgttcctccacagccgaggccacagcggtggtcagcgcccccaccttgccgatcgtgccggaaatcgaccggatggcatccaccgttcgcccggtggcactggtcgccgcatcgatctgaacctggatctcttcggttgcgcgcgcggtctgattggccaggttcttcacctcggccgccaccacggcgaagcccttgccggcttcgcccgcacgtgcggcctcgatggtggcgttcagcgccagaagattggtctgggcggcgatctgctggatcagctcgatcacgtcgccgatcttctgggcgttcgtcgccaggtcctgcaccgtattgtcggtggtgccggcctcgtccaccgcagcacggctcacatccgcggtctcggccgtccgggcccccacctcgcgcaccgatgccgacagctcttccgccgccgtcgccacggtctggacattggcggtcgcttgttccgccgcggccgccaccgccgtgctgcggccgctctgctcctctgccgtgcgcgacagggcatcggcgctgccgcgcacctgttcggccgcccccgacagcgtcgagacgatgccggccacccggttcacgaagccctgggtcagcgcctcgcgccgcgcacgctcggcctcctgcgtcgcctgcgcctgcacctgttcggccgccagccggtcggcctcgatcagcccggcacggaaggtctcgaccgatttggccatggcgccgatctcgtcgccacgatcggcaccggggatggtgatgcccgtctcacgcgccgcaagccggttcatcgcctcggtcatccgccggatgggcgtggacacgctgcgcatcatcagcagggtcgccgcgatcgccagcacaaggccgccccccagcgccgcgatcagcacggtcatgccgttttcggccgcacgcctggtctgttcgcccgacccagccgcggcggccgagttgaactcgatcagatcgtcgagttcacggatcagcagcgtgcggttggccgccgcgaacaatccccgcgccccatcctgatcaccggcacgaagatccgccaccagcggctcgttgcgggcaagataatccgcccaggcgaccttgacgccctcgaagtggccgcgctcctcctcgttggtaaccaaaggctcgtaggcggtcagaagcccgccgacctgctcggcggctttggccgcatccgcaagccgatccttcacgtccgcgtcttcggtagcgatgatcgccccggaaatattgatgcgatgttccgagaccgcattctgcagccgcgcgatcagcttcaggctcggcacgcgattgtcccgcagatcgcccgccgcctggtccagaaccgacaactgagcaatacccgacacactcgtcgcggcaatgacaagcgtcaacgccacgaacgcgacgatcagcctggcgccgatcgtccatttcgatgtcttcataaatactcgcttatctggggagaagctctgcgacgtacgtgcgcgggcagacactcttaaaaatagactcattcaacagtgtggttcaacatttaaatccgcggaaatcttcgggcgaaatattgtcaggcggcccgatctggcccaaaaagaaactggcgggccttatcgcagggcccgccggatccggaatcgaagatattcatcgatacgactgacgcaaacttgcgtcgattcagcaatctcagaccttggccacctcgtcgacatagcggtcgaccacgtctttcaactcgcgggtcttgccggccagggcgcgcgatgccccgctcatttcctcggccgaccgcccggtcagcccggcggccgatgcgatgccggcaatcgattccagcacttccgacgtgccggacgatgcctgctgggtgttgcgtgcgatctcggcggtcgccgccacctgctgttccacggcagaggcgaccgcggtggtcaacgcccccacccgggtgatggtgctcgaaatttcgcggatcgcctccaccgtgcggccggtggcgccggtcatggcgttgatctgtgcctggatctcttcggtcgcccgtgcggtctgggtcgccaggttcttcacttccgatgccaccacagcgaagcccttgccggcctcacccgcacgcgccgcctcgatcgtggcattcagcgccagaagattggtctgctcggcgatctgctggatcagttcgatcacgtcgccgatcttgcgggcgctggcggccagttcctgcaccgtaccgtcggtcgcctcggcctggcgcaccgcggcgcgggtgacgtcggcggtctcgaccgtgcgtgcgcccacctcgcggatcgatgccgccagttcttccgatgccgtcgccacggtctggacattggcgctcgcctcttccgccgccgccgccaccgtggtgctacgtgccgactggtcatcggccgtgcgcgccagaccgtcggcactgccgcgcacctgttccgatgcccccgacagcgtggccacgatggtggcgatccgcgacacgaagccctcggtcagcgtctcgcgcttctggcgccgggtctctgcctcggcgcggctacgctcctgctccgccgccatcctgtcggcgtggatcatgccgtcgcggaaggtttccaccgccttggccatggcgccgatctcgtcaccgcgatcggcgcccgggatgtcgacgccggtatcacgatcggccaaccgccgcatcgcctcggtcatctttcgcaccggcgtcgacacgttgcggatcatcaccagcgtcgccacgatcgcgatcaccagccccaccgccatcgcgacccccagcacggtgatcgcgctttcataggcggcccgcgaccggacgccggccgtgaccgagttctcgacattcatctggcgcagcttgtccagctcggccaccaccgcctcgcgcgccgcccggctctcgcccagatacagcgcgtcggccgcgacactgtcgccgctgcggacggccgcaaccatcttttcggtggctttcagatacgcctcccaggcggccgccaccagcttcacctcagccgcttccacctcgtccgagaccaggccctgatagactttaccggcagcggcaaaaccctctgcatagccgctcatctgctccagataggccggtcgtttggccggattgtcatccaccaccagccggctggcggcgatgcggtggttctgcaccgcattgctcgcctcggcgacgatcttcaggcttgggatacggttgtcgcgcaactcataggatgcgtcttccagcgtcgccagctgcgagaagccgaacacgccggtcagcaggatgaccgccgtcagggttgcaaaagcgatgatcagcttcttgccgatcgacagagaggatatggacatcgcggatgatctcgaaaaccagaggggagacccgcgggaacggcaaacgggccgctgaatatttagcgcccgcataccttaatgaatcgataaatggcgagacagagctgaccacaagatcatagcactatctcgccattcattacttcagatagaatatggaagcatctacatctacatcaataatattgatcgaatgacgaccacgccggtcagacccgcgcgatctccgccacataggtgtcgaccacccgcttcagctcgcgggtgcgctccgccagcgcgccggatgcggcgttcatctcctccgccgcctggccggtatggccggcggcatcggcgatgccggtaatggactgcagcacttccgacgtcccggacgatgcctgctgggtgttgcgggcgatctcggcggttgccgccacctgttcttccacggccgatgccaccgccgtggtcagggcacccaccttgccgatcgtccccgaaatcgaccggatcgcctcgaccgtgcggccggtggcaccggtcatggcgttgatctgaacctggatctcttcggtcgcccgggcggtctgggtcgccaggttcttcacctccgacgccaccaccgcgaagcccttgcccgcctcgccggcgcgggccgcctcgatggtcgcgttcagcgccagaagattggtctgggccgcgatctgctggatcagttcgatcacgtcgccgatcttctgggcgctgcccgacagttcctgcaccgtcgcatcggtctcttccgcctcggtcaccgcgcggcgggtgacgtcggcggtctcggccgtgcgtgcgcccacctcgcggatcgacgcggccagttcctcggccgcggtcgcgaccgtctggacattggccgtcgcctgttcggccgccgccgccacggtggtgctgcggccgctctggtcctcggccgtgcgcgacagctcgtcggcgctgccgcgcacctgttcggtggcgctcgacagcgtggtcacgatgccggccacctggtcgacgaagccctgggtcagggtctcacgccgctgccgctgcgcttcctgcgccgcgcgggcctcttcctgctcggctgccagccggtcggcgcggatcatgccgtcgcggaaggtctcaaccgccttcgccatctcgccgatttcgtcgcgacgtgcggctcccgggatctcgaccccggtatcgcggtccgccagccggcgcatggctgcggtcatccgcttcaccggcgtcgacacgctgcggatcatcagcagggttgccgccaccgcgatcagcgcaccgatgatcatcgcggcgatcagcaccgtatgggcggtgtcataggcctgatcggcgcgcgtgcccgaggcatctgccccctcggtgttgtgcacggtcaacgccgtcaatgcattgccgagggacagtcgggcatcgcgggtctcgccgcgatagatctgctgggccgccagcaggtcgttcgccgccagcagggccagcagctggttgctcgaccgttcatacgggccccaggcggtcgtcgcccggccgaacagccggcggtcctcgtcgtccgagatcagcttctcataggcggcgaaggactcggtgaccgcctcgccggccttgcgggcgcgctccagcagcggcttgcggttctcggggctgccttccagcaccgcgccggccaccgccagccggtgttccagcaggttgttcgacaggcgggagatgatccgcaggctgggcacccggttgtcgctcagatccatcgatgcctggttgagtgtgccgagctgcagaagaccgacgatgccggtcacgatgaccacggcggtcagggttgcgaaggcgatgatcagcctggcgccgatcgattgggtcagtctggacatgacagcggctttatcctggggaggaggtcatgaaatacgggcggccgatggcgggggagcccccgtggccgcatcgtcgcgcatggaacaatcaggttgattaacgaatcgataatcccgcatcggaattcggccgcagccgtttgattcatgaagtcttcatccccatttcaccaagacctgtttctaccggaccaacgacattgggaggaaatccgaacgatgctgatccgcgccgactttgcggcccctgccctggtccgtccggacccacaggactggatcgcctcgcccgcggccggcgtgcaccgcctgatgctcgacagggtcggcaacgaggtcgcccgcgcgaccagcctggtgcgctatgaccggggcgccggcttttcgccccatgttcacgggggcggcgaagaaatcctggtgttgagcggcgtgttcggcgacgagcacggcgactatcccgccgggacctatctgcgcaacccgcccggcacgtcccatgcgcctcgggcgcccgaggggtgcatcctgttcgtgaagctccgccagttcctgccgggcgaccgtctgcagctggccctgccggtcgacacggtggccggcaccgccctcgccggcgccgccggggtgacggagcgcctgctgcacggcttcggccccgaacgggtcaccatgctcgatctcgcgcccggtgccgaactgcccggcggcaggcggccggggggagaggaggttctggtggtttccggcacgctgatcgatggcgcccacggggttctgccggccggcagctggctgcgccggccgccggggcgggtggctacccgccgcaccgacggcggctgccggctttatgtcaagaccggccatctgccgcccgatcttcaggcctttgccgcatgaccgccggcgggctgccggagggtttccggatgcgccgcacggaaccggccgatgccgatgccctggctcagttgatcaccaccgccttcggccgcaccgacgaggccgatctggttcgcaaacttgctgccgcaggcgacgtttccctgtcgctggtcgccgaggatggcgccgggcagctgctcggccagatcctgttcggcccgcttggcatccgcctcgacggtcgcgacgaccgggatgatccgatccgcggccgcttcctggcgccggtctcggttctgcccgaccaccgcaggctcggcatcgccgccatgctgatccgcttcggcctgtcgcggctgcgcgccggtggtgccgaagcggtcttcgttctgggcgaccccgccttctacacccgcttcggcttcagcgccgagcgcgccgcaggcttccgatgcccctggtcgggtccccatctgatggcactggagcttacccccgacattctgggcgacggccggggcaccctcacctatccgccggccttcggtggagcctgaggccgcatcgccggcttacctctcgaaacaatcttccagtacgatcgccgatcgcgtgcgctccaccccgtggaacgcggcgatccggtcgatcagggcgttcagccggtccagatcctcgcagcccacttcggccagcaggtcgaaggggcccgagaccgcgtgcagcgaattcacctccgggcaggccttcagctgctggatgacctgccgccccagcttggggcgcagctcgatcatcacatgggcccggaccttcggcaccagccgctcgcccagctccacccgatagccgcggatcacccccgtggtctccagcaccgccagccggtgacgcagcgccgtgcgcgacagaccgacaatccgggccagcgccgcgatcggcatacgcgcgtccactttcagcgccgcgatcagcgcccggttcaccgcatccagttccggctccgccatcgcatccgaccctttctgacccgtattagccgattcggctattaacggcccgaaaatagccgtttcgtcaagtggcacccgcctcttcccagccgcaatgatcatcccagggacccagccaacagacccccaagggagaccagatccatgcgcatcctgatcctcggcgccggccgcatcggcaccgccgtcgcccatatgatggccgccggcggcgcccacgagatcaccctcgccgaccgcagcttcggcgtggaggccggccagctgtcgtcgcgcatccggcgggtggaggccgatgccgccgatccggccgccctggatgccgtgatgcagggccatgacgcggtgctggccgccggcccctaccatctctgcccgcagatcgccgaggcggcggtgcgtaaccgcctgcactatttcgacctcaccgaagacgtccgctccacccgcgcggtcgcggccctggcggccaaggccgaaaccgcgctggttccccagtgcggcctggccccgggcgtggtctgcgtgatggcccacggtctggcccatggcttcgaggccgtcgacgccgcacgcatccgcgtgggcgcgctgcccgcccatcccaccggcccgctgggctatgccatgacctggtcgaccgccggcgtggtcaatgaatactgcaacccctgcgaagcgatctggaacggcgagcgccgcgaagtcctgccgctggaaggcgaagaaaccgtcatcctccacggcaccacttacgaggccttcaacacctcgggcgggctcggcatgctggccgatgcgttcgaaggcaaggtccgcacgctcgattacaagaccctgcgctatcccggtcatcgcgcgatcatgaagcttctgctcgaagatctgaagctgcgcgaccggcgggagctgctggaacaggttctggaagccgccgtgccgaccacggaccaggatgtggtggtgctctcggtctcggtcgacggcatcgccgacggccgcctgacccgccgctcgtggagccgcgaagtcggcgcccgcgaggtcgacggcatgcacatgtcggccatccgcctgaccaccgctgccggcgtcgccgccgtcatcgacctcctggccgaaggccgcctgccccgcaggggcctggtccgccacgaccacatcgacgccgacgccctgctcgccaaccgctatgggcggcattacgcctgatccgaacacagcccgaagaggcgcccaccgctgcggcgcctcttcgactgcccgcaatgggccgtggtttccctaccgatttgccagtggtaggttggagccggggcggatgtgaccagtaaggacgccgtggtttccctaccgatttgccagtggtaggttgagcgagccatcgcagagttccttgacgtggccgtggtttccctaccgatttgccagtggtaggttgatttgagcgtcaaggcccccaagcttccggccgtggtttccctaccgatttgccagtggtaggttccccgctgcgtggaccagctgagtgatcgtgccgtggtttccctaccgatttgccagtggtaggtttcgctgtccgacgccgaccgctaccccctggccgtggtttccctaccgatttgccagtggtaggttacagccaagtacatcggcgacccgacgctcgccgtggtttccctaccgatttgccagtggtaggttacctcgctcgcaacagattgatcctgctgtgatttccgccgggaatgccgcgccgaaatcacagcaggaccatctgattggtgccgaggcgctcggtttttgaggcgaggccgagcatgacttccatacgcgcatactgcttgtccgtgatctgaagcgttcgcacgctgccctcccgcggcaggctgacgcggacgcgcctgatatgcttgtcgaccgcgtcctgcccgcggcagacccgtgcatagacggaaaactgcagcatcaggaagccgtcatccttcagcgctttcctgaagcgggtggccctgcggcgctgctcgcgggttctgaccggcaggtcgaagaataccatcaaccacatgaaacggacatcctcggctttcatggcgcgccctcatccttcgccgggccagcctggcatctgaagcagggctgcactgctgttctccatagcccgtaccatcgaggtggcggccacttccgtcgctgccagcagcgtcatgcgatccgccccgatcgccaccgaatggttgagaatgcccgccatcgccctacggtcgtcgacggtcagctccccgctggcctcatcccgcgccagatcgtgcaccgcccgatcgacgaagggccggaacggctctatcaggtcgtcgaccagattgaaggaattggttcgggatgcatgatggacgccgaaggccggcaacagcccggatgccgtgcaggcccgggcaagtgccgcccggaccaccgcatagccgtagttcaacagggcgttgcgccggtcaacttcattgccccgtgtgaaatcgcggaacagttccggccagtagacgcgcgccgcctgcgcttcgatgttgtcgggatcgcccgacccgacccgacccgccatggctgagagagccttggcccggggccggtccaggcgatccagcagcacggcctgattgccgatcttggcgaccaccagggcctgccacagccgctttttcagcggcaggccgatgcccacctgcatatgcgccacatgggcctgtgcgtgatgctggtggaagggcaacagcacgcccgccggatgatgcttcgcatccggcacgatcatcgccaccccccgccccgccagggcggagagcagcgcgccggtgacgctggtctgcggcgtgtcgagacaccagccaggcaatgtcctcgatcgccagaaaaacctcgccatcctcctgggcaacgatcagttgcccgtcccgaaagctcaatcgggcgggacgggagatgtgcacacctctccatgccatgttctgacctcacttttcacttcagtacgcaccccaaagcgatccacattaaatttcctgagattcaacaatgttttcgctccgattcctttcgccatttccgcgggattattatgaacaaagacgcggaaagcgcctgtcgaccgatccattgagacaagatatccttctatgacgtcaccattcgacttcaccagctggacgtagctgcgcggatacagactgaagcggaacgagtgctccgccccgatctcggtccagccggcctcgtccttgtaggccacaacagaccgcatcggcggatgcggccaggccttccggttcatcacctgatggggatagatcggcaccagataccattcgtcccggcccttgcggttcggcctagtgaagacgtcgatacgcaccatgtcgccgcggtcggcggttccgccccgcaccggcaccgccggcttgatctttttggccggcgccgtccgcagcttgacgatgacgtcgccgcgcggtgaccgcggcggtgcatcggccggccggccggcgaggatccaggcgcgcacggcctcgatgatcgcctgattgcgctcaggatccttgacccggtcgagatccgcttccttgagatccgccagaccccggcgctcgaacacctgcgcctccgggccctctccgacaacctgacggatactcgcatcatgccccttgccccgcgcccgacgacgctcagggcgggcgacgaatgcctgcgcataggccgccagaacgtcgccgcggaagccgggccagggtggcgccacatggcgcagcgggcgggcgagcccctgctgctcccactcctggaaagaccgggtgaggcgctgaacctccctttcactgatcgccgccacggcaagtgcatccagggcatggtggcggtcgtcgctcacccgcttgccgtcggccttcttcaggctctccagcccccaggcatggcgcagcgccgcggtcagcggtccggggcgggtcagaacccggcggcgcccgtctttctcctgccggtcaccggccggatagaacagcttcgcagcctccgccagcagccgcgccgcatagcgggtgtcgttcagattgcggctgcggaagcgctgagcgacctcgtcggcattcttcagaagcaggttgcgcttcttgaagccacgcagatccttcgaggtttcaacccggctcgcgaagacctcccaggcctcgggcgtcccggtcaggctgaaccattcccagggtgtctgcccgcgcttgcgctgattcgcgctcgcaaggcacaaggtcttgttgttgaagctgtcatcgccgaaccgggaccagggcaggatgtggtccacctgcacgctgttgtcggtggcgatcaactgccggacatgaatgtccttgccggtgtacaggcatttgccgccctgttccttccacaaacggtagcggagcagggtgtcgtcgtcgacgtcctccagagccagcagcccgcggatttcatcccgctcggtctggcggcgcttggtcgtcgtctcccgttggctctccagttctcggcgcttttcgatactgttgccgacctctcgcgccagttctatatggatggcgccgggcaggccccagcgggcacacatcgcgcggatctgcttcagcccctcggtcagcgccttgcgggcgatgggattggcgatgctctcgcccagctccgtcaccagcgcgttgaacccggccttgctcaccacctgagccgtgtgcgacagggtcgatgcagcatggtcatagcctgcaagccgacaggcctgatcgtagcgatggccctgttgcagatggggcagcagattgcggcaggccttggcggagatgtgtccggcccccttgaacttcgcgaacgccccgtcttcgagcccccggtccagggcctcgatcacggccgcgggcagtcccagccggtcgagttccgaccggatcttcgccgtggcttcgaagaaactcaggacatgcgcaatggcgtccagctgatcgggtcgggcctgcatctccgcccacagcgcctcgcccagggtcttgcgcagccgccaggtaccgggtgcggcttcgccggttcgggcaacgatatcgcgatcctcgtcctcaacccgaatcgtggtgaaacgctcgtcaggcagaagcccgatcaaggcgcgcacgcggctgaccgggagttttgccgtcgcgccgagttcggccgagacgcgggccagatcttccggggtgaacctgcgctccccttcggccgtcgcgatccgcaaattgatcagccgggtcagcagacggaaacgttcgaacgagggcgcccatctggcggcgcgcttttcatcccgctcgaacgggcaattccccacaagacgttcactgtcctgcatctccgcctgacgaaaggcgatcgcgttgaaatccgcctccagatcgggcgaggcgaaagcgctgccgcgcgccctctgcgcttcgaacagcttgccgacctcgtggatcagatcgtcccgcgcgacggtccggtcgaaaatgccgtcacggttccggcgccgtgcactgtattccggatcgcgggcgaacatctcgccgacggtgcgatagcgggcagtacgctccctcgtcaccagaagggccgacagcatcttgctatcttccccactggtattcgcggccttgcgcttggcggaggagcggaagccacgatgcctggcgatatgaccgagcgccaccgcgaattcttcggcactcaggcattgatcgagccctcgggcccgcaattcccaggggtcgagacgcggacgcttcagggcgtcctcatccgccgaaggcagcaggccctgggcatgaaacagacgcctgatctctgccatgcgattgcgccgccgccggatgacccggcggagcaggcgattgctgcgccggacctgattggtcgggatacgctccttgctcgtctcgggcacatcgaagcaccagcttcccagcccctcgatcacccccggctctccggcggcatccgcatggcgaagcaccgcccagccacatgatccgatgccaagatcgattccgaacgtcaggcgttcgttgatcatgccccctccaagatctcgcttgacttccctgcgtcctcgaggccaactgtgcttggcaaatcggtagggaagccacggtaacagacttaccgtaaggtttctctgtgaaggatcatcccccattgggcaaccaatgggggaaattcctcatcaatacattgatgagatgctgaatccttccgatgctcattcgcagatcgatgaattgcagcgcgacgcgacttcgcgcagacaggcgtgtcgccaaagattttaccacatgatcacctgacgacgtttcatcgaacgcccgccgattatccctgtcaagaaaccatcgtgatcgacatgcccccgcaggaatggatggcgtgatcgtccgccgctctccggggcgcccgggcggccagacagtcgcgctggaggaagatcatgggtggactttccgcccgatcgggatagaacaaaagggatcgcctgcgtgagatttccgggtcttcacccccgtccgccagacgggggtgaagacccggcccccgctggtcgtgcgctgagttgagcgcgacatcacgtggtcgcgatggatgtttcggaggatgacgaggccggcacgggcacaccggcgaattcagaagcggatctggaccgatggtcatgacgacgcggcgggacatgcgccgcatcacggttgcggcgggcatgctgctgagtgtcgcggctcttgccggcaccggcggggacgcccgggccgagggtgtctcgctcaccatttcctgcggcgcgatcggtgtcgagctgtcgctctgccgcgacggggtcgccgcctgggagaagacgaccggcaatacggtcgacatcgtctcgacccccaattcctcgaatgaacgcttcgcgctctatcagcagatcctgggcgccggcgccgacgatatcgacgtgctgcagatcgacgtggtctggcccggcatgctggcgccgcatctggtcgatctgtctgagtatatgggcgatgcccccgcgcagcatttcccggccctgatcgagaacgacaccgtcgacggccggctggtcgccatgccctggtggaccgatgccggcgtgctctactaccgcaaggatctgctggacagatatggtcaccagccgcccgagagctggtcggatctcacccgcatcgccgccgacatccagcagaaggaacgcgcggccgggcaggccgatctctggggctatgtctggcagggccgggcctatgaaggcctcacctgcaatgcgctggaatggatcgacgcttatggcggcggcaccatcgtcgatgccgacggccgggtgacggtgaacaaccccaaggccctggccgccctgacagaagccgcatcctgggtggggacaatctcacccgaaggcgtgctcacttatgacgaagaggccgcgcgcggcgtgttccagtcgggcaaggcggtgttcatgcgcaactggccctatgcctgggccctggcgcaaagcgccgacagccccgtgaaggacaaggtcggcgtcaccgccctgccgccgggggcccccgagggcaagaccaccggcacgctgggcggctggcatctggcggtctcgcgctattcgaagcacccggccgaggcggccgatctggtgcggttcctgaccggcgccgccgagcagaagcgccgcgcggtcgaagccgcctataacccgaccatccccgccctttacaaggatgacgaggttctggccgccaacccgttcttcggccagctctaccagaccttcgagaccgcggtcgcccgcccgtcccgggccacgggcgatgcctataaccggctctcggccgccgtctggcagcgcacccaggatgcgctggccgggcggatgacgcctgaagccgccctcacccgcctcgatcgcgatctcggccgcctgtcgcgcggcggacgctggtgagcgcgaccacgggcaacgccggccgcggttccgcccgcaccgcggcgatcttcctgtcgccgatgatggcggtgctggcgctggtcgcggtctggccgctggcccggaccatctggttcggcttcaccgatgccagcctgacggcgcccggcgattacggcctggtcggcttcgccaactatctggaagcctatgacggcgcctggtacggcatcctggccgatccgacctggtggcgggcgcttgccaatacgctgatcttcgccgccgcctcggtgacgctggaaacggtgctgggcatcgccatggccctggtgctgaacgcggacttccccggccgcggctgggtgcgcgccgccgttctggtgccctgggcgatccccaccgtggtctcggccaagatgtgggcctggatgctccacgaccagttcggcatcgtgaatgccgggctgatggcgctgggcgtgatcgaccggccggtggcctggcttgccgatgcctcgaccgccctgccggcggtgatcctggtcgacgtctggaaaaccacgcccttcgtcgccctgctgatgctggccgccctgcagaccgtgccgcgcgactgttacgaggcggcccgggtcgacgggatccccgcctggaaagtcttcattttcatcaccctgccgctgatccgcccggcgctggcggtggcggtggtcttccgcctgctcgatgcgctccgggtgttcgatctggtctatgtcatgaccggcaatgccgaggcgacgatgacgctgtcggtccatgcccgccagcagctggtccagttccaggacatgggctatggctcggccgcctctaccctgctcttcctggtggtggggttggtcacgatcctgtggctggcggtgctccgccccgaccgatcggcggccggcggccggcacggaggggccggcgtatgacccgccgcacgccgcttgccgccatcggtctcggcctctcggtcgtcctgctgctgctctggtcgctgttcccgctctattatgccgtgctgacctcgatggaaagcggcagtggcatcttccggatccgctggtggccggaggcgatcgaattgggcaactaccgggccctgttcgccaccggcgccttcggccgcagcatcctgaactcggtgctggtggcggtgctggtggtgaccgcctcggccgcactcggcctcaccgccgcccatgcgctggggcgtatccgctttcgcggccggcggctgatcctgctggcggtgctcgcggtttcgatgttcccgcaggtggccgtgctctcgggcatgttcacgctgatccgcgggctcggcctctacaattcgctctggggcctggcgctcgcctatctgctgttcaccctgcccttcacggtctgggtgctgaccaccttcatccgcgagttgccggtcgagatcgaggaagccgcgatcatggacggggccggccccttcaccatcctgatccgcatcttcctgccgctgatgtggccggccatcgtcaccaccgggctgatcgccttcatcatcgcctggaacgaattcctcttcgccctcaccttcaccctcaccgacgacatgcgcacggtgccggtcgcgatcgcgctgctgaccggcggcagccagcacgaactgccctgggggatgatcatggccgcctcggtcacggtcaccctgccgctggtggcgctggtgctggtcttccagcgccgtctggtggccgggttgacggcgggcgccgtgaaaggctgacgcgcgctcatgaccgacgatctgccccccatgctggaactgcgcggcctcggccgccgctatggcgcggcccatgtgctgcgcgggctggacctcgccgtgccgcacggcagcttcaccgtggtggtcggcccctcgggctgcggcaaatccaccctgctgcgcctgatcgccgggctggacgcaccgagcgcgggcgagatcctgatcgacggcagcagggtcgatcagctgccgccggcgaagcgcggcgtttcgatggtcttccagtcctatgcgctctacccgcatatgaccgtccgccgcaatatcggcttcggcctgaagatcgccggggcctcggacgccgacatccgcgcgcggatcgccagggccgcagacatgctgaagatcggcgagctgatggaccgcaggccggcccagctgtcgggtggccagcgccagcgggtggcgatcgcccgcgccatcgtgcgcgaccccaaggtcttcctgttcgacgagccgctgtccaatctggacgccgcattgcgggccggcacccgggtggagcttgccgccatgcatgccgatctgggcgccaccatcatccacgtcacccatgatcaggtggaggcgatgacgctggccgaccggctggtggtgctgaaccgcggccggatcgagcaggcgggcccgccgcatgatctttacacccgccccgacacgctgttcgtcgcccgcttcctgggcagcccgcagatgaacgtcgtttcccccgccagcgccgccggccgggcactggccgcggcgggggatctgccccagggcaccgcctggatcggcatccggcccgaggatctggcgatcaccgccgccgacgcccccgatgcggtgacgaccggccgggttcggatgatcgaagagctgggcgacagccggatcctgcatttgcgggtcgatgacggcgacgaaatcgtggtccgccatcatcagccggcgccgcccgccggcgacagggtcggggtcaccctccgtgcggccggcctgcacgccttcggggccgatgagcgccggctggcatccggtcgattttctgtctgacgactcgcgatatacgcgatttgtttaccccttttcgggacagtgtaggatctgaaggacgtacacgccgaagggggcggaagatggacatcgccacactggcgatctacaacgcctggatcaccgtgaccctgaccatcggcttcgccgcggtcagcgcggcacggcgcggtccggcccatgttctgtggtggaccgcgggcaatgcggcgcgggcgatcgcctcgctggtgctggccttcaacctcgcgaccggcgatctgtcgaccacactggccgcaaacggcctgctgctcgtctcttcggcgctctacctcacaagcttcgaacgcctgaccgggcggcgtggcctgatgccgcccgccatcgcggtgatcgcggtcacgatggggctggtgctcgccttcaccatcgccagccccgacctgaaggcgcgcatcgtctcctattccaccggatccgggctgctgctgatgatgtgcgcggtggtcgcgatccgcaacgacatccggggccgggcgcggccgtcgctgcacgccgccgggatcgtcttcgcgattttcggcggtctgaccctggcgcggggtctggcgacgctggcgggcccggacatcgacagcgtgctggccagcacctgggtccagagcggctttctggcactggccggcatgttctatgtcggcagcaatttcgcgatgctgtggagcatggtggtcgaagacggcgagcgccacgcggccgagctggaaaacgcgcgtgaggcggcagagcgggccagtttcgcgaaatcgcgcttcctggcgaccatgagccatgaactgcgcacgccgctgaacggggttctgggggcggcccagctgctgctgggcgatcccggggtgggcccggggccgcgccagcgggtgcagatgatcgcgagcgccggccggcatctgctgggtgtgatcaacgacgtgctcgacttttcgaagatcgaggccggcaaactggaattgcagccgcgcgacggggtggatctgcgcggcctgctgaccgtggtcagcgatgtcgtcgccccgcaggcgacggccaagggcctggttctgatcaccgatgccgcggccgatctgccgcacgccatccgcgccgacgcgatgcgtctgcagcaggtgctgctgaacctgctgtcgaacgcggtcaaattcaccccccatggccgggtcatcctgcgggcccgccggggggaggacgggtggctgtgtttcgaggtgcaggatgacggtccgggcatcccgcccgagcgccggcatctgctgttcaaggatttctcgcagctggacgaggccgcgagtgccacggcgggcaccgggctgggccttgcgatttcggcgcggctggccgccgccatgggcggccggctggaactggacgacagcgtcacccgcggcgccctgttccgcttcgaggtcgccttgccggaaaccgccctcaagaccagcagggcggccgcagcgctggaccgccctgaagccgcaccacccccgccgcccgccaccggagggcgcggcccgcgggtgctggtggcggacgatgtggagatgaaccgcgaggttctggccgccatgctcaagcgcctgggctgcatcgtggagaaggcggaagacggcgccgaagcgctggccatcgccgcccgcggcggcatcgatctggtgctgatggacatgcgcatgccggtgatgaacgggctggaggcggcgcgcgccatccgcggcctgaccgacccgacgctggccggggtgccgatcgtggcgctgaccgccaatgctttcgattcggccatggaacaatgccgcgaggccggcatgaacgactatatggccaagccggtccagctgtccgaactggccgagatgctgcagcgccatacccgcgtccgccgggccccgccaccggtgccgccgcaggccgccgcgccgcatcccgatggaccggtcgaggcggtgggcgacgaaatggcggcgatcgacaggctgcagcgtcagatggggcaggatcgtgtggcccagatgctcgacggcttcatggccaccgccaccgaccgtatccgccggatgacccacgacgccgaccctgtggtgctggccgacgatgcgcggacgatcgcgggccaggccgccctgctcggcctggatcaactggccctcatcggccggcgcctggcgatcgcggtggagaacgacgaggccgagcacctctgccgcggccatctggaggccttcaccagccggctgcgcgcgaccctggtcgagctgctgctgcgccgggcacggctcagggaataccagccctattgaccggccccggcctgcgggccacctgcgccgatgcgcgcggcccgcggctcgtgctaacgtcctgccgtccacgatacccccgcgcaaggccgggggacccgaccgacggaggaaacacgggtcatgacgttgaagatctacgggatgagcgcgtcgcgcacctcgcgcaatctctggatggccgaggaactcggcatcgcctacgagcacatcccggtcaagatcgccgacgcggcgagcgatcccgacattgcccgcctcaaccccaatctccggatcccggtgatcgaggatgacggcgttgtcatcaccgaatccatggcgatcaacctctatctggccgcgaaacacggcgggccgcttgccgccggcaatgccgccgaagccgggctgatggcccagtggagtttctgggcggtgaccgatctcgaggcgctgtcgctgaccgtgctgctgcaccgcctggtgctgcgcggcgaagcccgcgatgccgcccgcgccgaggcggcggaagccagcctcgcccgaccgctcgccgtgctcgacaaggccctggccaggggcgacggctggctggtcggcggccgcttcaccgtggccgacctcaatgtctcggccatcgtccactggctggcggcggcacgcatggatctgtcgggcgtgcccaatgtcgcggactgggtgaagcgctgccgcgatcgcgacgcggcaaagaccgcccagaagctgccctgagccttcaggacaccggacacccccaccaaaagctgcggccccgcccggcgccgtccacgtcccccgacggatggcgccccggcggggccgcttgcccccttcccccggggcagggtatggcgaggctgccgttactcggcaggccccgcaatcggcgcgcccaccagcggacgggccagccccgaggccggcacatgggcagggaccggcacatgggcagggaccacctcgggcgcatcatccagcggccggccggcatcgagcgtggctgccaggcggtcgcggtccagctccccttcccagcgcgcgaccacgatcgcggccatggcgttgccgacgaaattggtcagcgagcggcattccgacatgaagcggtcgacgcccaggatcagcgccatgccggcgaccggcacgctgggtaccaccgccagcgtcgccgccagcgtgatgaagcccgatccggtgacgccggcggcgcccttggaactcaacatcgccaccagcagcagcaggatctgatcgcccagccccagcggcgtgtcggtcgcctgggcgatgaacagcgccgccatggtcatgtagatgttggtgccgtccagattgaaggaatagccggtcggcacgaccagaccgacgacgggcttggaacagccggccttttccatcttttccatcagcgagggcagcgccgattccgaggaactggtgcccagcaccagcagcagctccgccttgatgtagcggatcaggcgcaggatcgagaagccgttggcacgggcgaccgcccccagcacgaccagcacgaagaagagggcggtgatgtagaaggtgccgaccagcatcgccaggttggcgatggagccgatgccgtatttgccgatggtgaaagccatggcgccgaaggcaccgatgggtgcgaccttcatcacgatatggacgatgttgaagacgacctgggtggtgatcttcaggaaggtgagcaccggcgcgccgtgctcgccgatcatcgacaggccgacgccgaacagcaccgagaagaacaacacctgcagaatatcgcccgaggcgaaggcgctgaaggcggtggccgggatgatacccatcaggaagccgatgagcgtctggtcatgggccttgtcggcataggccttgaccgcggcggcatccaggcttgccgggtcgatatgcatgccggcacccggctggacgacattggcgatcaccagccccacgatcagggccagcgtcgagaagaccaggaaatagatcatcgccttggcgccgacccggccgaccttctcaagatcgctcatgccggcgatgccggtgaccacggtcaggaagatgaccggggcgatgatcatcttgaccagcttgatgaaggcgtcgccgagcggcttcagatccgcgcccagctgcggatagaaatggccgagtacgatgcccgccgccaccgcgatcaggacctggacatagaggtgctgataaatttttttcggccgggccgcgcctgcctgcgcgccctgccctgcgagaccctgtgccatcgccggcgtcctcctccggattgtcgccggcgtgcggcgccggccgatcttggaatccggcccgccatcccctgccggcgggcccggaggccgctgttggcaatcggcgtgccagctggcaccatgacgatcaaatccttgaattccctgatggaataccccgcatgcgccatcggactttgcgcgaagcgtgcggatattcgcccaaaggggcggggattttggcgaactgccgcacaatgtgtggatttgcgcccgggtgcgattcgtcggacactgatgccatgaccgaccgcgccgccctcacacccccgggcaccaccaccgccgggcccgccgatgccagcctgatccgcctgagacggatccgggtctgggcggtattcgtctgcctgtggctggtgatcggcgggcttgtggtctggcaggccgggcggatcgcgcgggacgaggttctggccgatctgggccaggccgggcgggtttcgctgtcgctgaacgccgagacgctgggcgccgagatcgacaagcagcgcgccctgccggtggtgctggcgcgcgatcccgatgcgcttgcagtgctgcgggcaccggatgataccgacgcccgcgaccggctgaaccgcaagctcgaggcgctggcccgcgccacccgtgccgcggtgatctacctgatcgacgatgacggcctgacgctggcagccagcaactgggcgacgccggtcagcttcgtgggcaatgattacggcttccggccctattacgccgtggccatggccgaaggcgccgccgagcatttcgccatgggcacggtcagccaccgaccgggcatgtatctggcccggcggatcgacgacgatcgggggtccgttccgcgccatgggctgggcgtgatggtggtgaagatcgaattcgaccggctggaggcgatctgggccggcgcccccgaacggatcttcgccaccgatgcccgcggcgtggttctggtcagcggggtcgccggctggcgcttccgcagcctgacgccgctgcccgaagagatgcgggccgcgatccgtgccgggctgcaatacggcgatgcaccgctcgacccgctgcctttcgcgcccgcggccggcgatcagacgctgctgcgcgtcgatgatgccgttttgctgcatcagagcctgaccatgcccgaaatcggctggaccctgcatctgatgaccccggccgaccaggcgatgctgcgggcggtggccgatgcgcgcgcgctcgccggcaccggcatcgccctgcttgcggccctggcggccgccgggctgtatcgccgccagcagctgcaaggccgggccgcccgcgccaccctggaacggcagaggctggaggcggcggttgccgaccgcaccgccgatctggcccgcgcctatgcggcactcgaagccgaaatggaggaacgccgccaggccgaggccgccgcacggcgcctgcaggacgatctgatccaggccgggcggctggcggtgctgggccggatcgccgccagcgtcgcccacgaggtcaaccagccggtggcagcgatccgcgccttcgccgacaatgcccgcgccttcctggaccgcgaccgggccgatgccgccctggccaatctgtcccgcatcggcgagctgaccacgcgcatcggcacgatcaccggccagctgcgcggcttcgcccgcaaggccggcaccgcccccagacccgtgctggtgacggaggcgatcgacggcgccctgctgctgctgggccaccggatccgggtcaccggcatcgacctggtctgcgacatcccgtcagagaccggcgcggcgcgggtggtggcggagcgggtgcggctggaacaggttctggtcaacctgatcggcaatgcgatcgacgcggtcgaggggcaaccgacaccgcggatcgccatcacggtcgcgcgcaccattgccggggacggcacggcgcggctcaggatcctggtctcggacaacgggccggggctgccgcccgatatccgcgaggccctgttcctgcccttccgcaccaccaaacccgacgggctggggctggggctggtgatctcggccgatctggtgcgcgacatgggcggcacgctggccgcagagccgcccgcggcgacgggcggcgccaccttcatcatcgatctgccggaggccagatgacccgcgagctgccacaggtggtcttcgtcgacgacgaggacgatgtccggatcgccaatgcccagaccctggacctggccgggttcgacgtgctgaccgcagcctcggccgaggccgcgctggcgctggtcgaccgcgagtttccgggggtggtggtcaccgacatgcgcatgccgggtatcgacgggctcaccttgttcgaccggctgcgggcacaggatccggacctgccggtgatcttcgtgaccggccatggcgacataccgatggcggtggaggcgatgcgccgcggcgcccaggacttcctgtccaaaccctatccggccgaggcgctggtggacgcggtgacccgggccacgcggctgcgccggctggtgatggagaaccgccggctgaaggccgccctggacgccgaggcggcgctggggctgatcggccgcacgcccgagatggagcggctgcgcgagaccgtgcaggcggtcgccgccgccgatgtcgacgtgctggtgttgggcgaaaccggatcgggcaaggaggtcgtggcccgcgcgctgcatgccggcagccggcggcggaccgcccggctggtggcgctgaattgcggtgccctgcccgagacggtgatcgagagcgagctgttcggccatgaacccggcgccttcaccggtgcccagcgccgccgggtcgggcggatcgaacatgccgatggcggcacgctgttcctcgacgagatcgagagcatgccgaagagcctgcaggttaagctgctgcgggtgctggagacccgcacggtcgagccgctgggcaccaacgacatccggccggtcgatcttcgggtgatcggcgccaccaaggtcgacctgttgcaggaagcggccgaggggcggttccgcgacgacctctattaccggctgaacgtggtgacgatccgcattccgccgctgcgtgagcggcggggcgatgtgccgctgctgttcgcccatttcctggagcgcgcggccgcccgcttcggccggccggtgccggcgccggacgatgccgtccgtcgccatctcgccgcccatgactggccgggcaatgtccgcgaactggcccatttcgccgaacgggtggcgctggggctctcggccgaaactgcaccgggctcagggcccctgcccgcgggcgcggccgggccgggcgacgacccggatctgcccctgccccgccgcgtggaccggttcgaagcgggggcgatccgcgccgcgctggcgctgcatgacggcgaggtcaaggccgtgatccaggcgctgggcctgccgcgcaagaccttctacgacaagctccagcgccacggcatcgaccccaacgactatcgccgcacccgtcggagctgatggcgtcgggactgatggctcaggcggcggtgacccggtcgatccaggcgcccagcaccgtcatcacctcgtctcgattggtctcgttcagggtttcgtgacgggcgccgccgaagacatggaccgagacatcggccaggcccgccgcccgatagcggccgaccagcgtatcaaaccagaccatgtcgccgccgaccgggtcgcgatcgccgatgaacagcagcagcggcatgtcccgcaccagccgcgcggtcgcctcgggctgccagatcgggccgcagacctcgaaaatggagccgaacgaggcctcggccacggtgaagccgcacaagggatcggcgatataggcatcgacctcggccgggtcgcggctcagccagtcgaagggggtgcgggcatcggggatggtctggttcaggtcttccagccggaaactgcccgaggcggcggcctggcccagcatgtcgaccgcggtggtgcccgacagcgccacgccgtccaccgcccccggatgccgggtcatgaaggcctgggcggcaaacgagcccatgctgtggcccaccagcacccgcttcagccccggatggcgccgccccagatcggcggcgatcaccgccagatcgtcgaccagcgccgcaaaaccggccgccccgaaatcgccgagcgtgccggcctcggccgccgccggcccgtggccgcgatgattggcggcatagaccgcgtgaccggcggcggtcagccggcgggcaagccggtcatagcggccgatatgctcccccatgccatgggcaagctgcaccacgccccggggcgtgccctcgggcagccaggcccggacccggatctcgtggccgtcgggcgcggtcaaggtgaaggcggtgtcgtcggcggtcatggcttgcggttcctccggtgccggcacgcgccggcaccccatgcgccggccggccggtcgttgtccggtatggtgaaccgtcggcgcagtcgacgcaatgcgccgatgacacgacaccgggttcaacccgcctcaacgcgattccggccggcgtccttggcccggtagagtgccgcatcggcgcgggtgatcagatcgtcgatgctgccggtctcggaatcggcggtcgcgaggcccaggctggcggtgaccgtcaggcagctgccgtcgatcaggccgaaactcctgtcggccagcgccgtgcgcaaccgctccgccgtggccaaggcggcgtcctgatcggcttcctgcagcaggatgacgaattcctcgccgccgaaccgggccagaatgccgccggcacgcatttcatcggcaagccgtttcgccacgcccttcaggatctcgtcgccggtgccgtggccatagcggtcgttgatccgcttgaagtgatcgatgtcgagcacgatgacggccagcgcgcggacatagcgtcgggcggcggcgagttcacgacccgcgatgtcgaagaaggaccgccggttcatcaccccggtcaggaaatcggtctcggccatccgcttcaggcgctggatcagatcctcgcggtcctgctccaccttccggcgctcggcgatctcggcggtcagctcggcggtgcgctcggccacccgcgcctccagcccgagattggcgcggaccagctcctcctgtttctgcgtcagcgcggcgatcatccgttgcagcgaccaggccaggtcccggacctcgcgatagccgccgtcgagcggcacctcgtcggggctgctggtctctcccacccgccgggccgcccggctcaaccggtcgagcggcgaggcgatgcgggccgccagccacagcgcaaagccgcaggcggtggccgcgatcgcgaccgcaccccacagaatcaggcggcgcagatcgcggaccggagccagggcctgatcgaccggctggcgcaccaccaccgtccagccaaggcccggatagtcgcgaaacccctggctgcgatgcagggccgtcagataggcgcggtcgccatcgggccaggtttccacccagggccccggatccctgctcccggcagtcagacccggcagatcgagtttctgcccctcgagcgcacgagggccgagcagaacggcaccatccttgtcgacgaccagaatgtcggtgccgctgcggctctcccccggcgcgatcagcgaccggcggatgtcgtcggcccagctccacgacaggtgggcgccgacgacgccgatcagcccgccctcggccatcaccggcatcgagacgtcgacgaaacgcagcggcgtgcccggatcggggttggtcagcagccgttccagaagcagggccttgtgaacgtcgccggcgaagggccctttgagggcgcccacgaaccagggccgggccgagacgtcttccccttccagcagccggccggtcgaggcaagaaccctgccctgcacatcggtaaagccgatccaggcgtaatcgggataggtctgctgcagaatttcaagcgcgacccgcttggcggcagtgtcgtcgccccgcagcaccggccgcgcggcgatgatccggatgtcccgccagcgttcgaacatcgcgcggtcgagcttgtcgctcatctggaaggcaagctcgtccagactgtcgccgatctccgccgcctgccgccgtccggccacctctgccaccacaagggcgagcaaaaccaccgtggtcagggcgagcccggccatcgtgacggtgagaagggttctgagccccggccggcccagccgacgagggcgacgtattccgcgatccggaccggtcgccgtcgccatatgtcatggtccttgtgtctcacggcagcgcttcacggttttaacatgctgtcctgccccttgacagagatcgcattccaccgccaccttttgcgatagcagtgcccccggattgggaaggtcgccatgccgatggtgatggtttcgtggagacggtgctcccgtcgaaccggcaacggttcgcggacgggcgcgccgtcatgcgcggcccgccgggcggaccgcgccaaggcctggtacaatcaggacatcgtcctcgcctatgatttcccgcgggcctgatcgcgcccgcggccgcccgtttcagggccgggccgcccttttctccgacagctttacgccccaccgcccgaaccggatgcagccgcagccggatgtcgtggccgtgcgggcgccccaccgcccgtcgcatcctgcgtgatgccgcggcgggcggcttgtcaggacatcgcgatcagatgacccgcattcccgaacccttccgcatcaagatggtcgagcgcatccgccagaccacccgcgaagaccgcatcgccgccctggaagaggccggccacaacctgttcctgctgcgcgccgaggacgtctacatcgacctgctgaccgacagcggcaccggtgcgatgagcgatgcccaatgggccgcgatgatgaccggcgacgaggcctatgccggcagccgcagtttctatcgcctggaagccgcggtgcagcggctgttcggctatcgccatgtggtgccgacccatcagggccgcggcgccgagcagattctgttcccggtgctgatcgcccgggcccgcgcgcggtcgggcaaccccgccgcgcggccggttttcctgtccaaccatcatttcgacaccaccgccgcccatgtcgaactcgcgggcgggcgcgcggtcgatgtgctgacgccagccgcctacgacaccggccggcccttcgactggaagggcaatttcgatctcgaccgcctggcggccgaaatcgatgcggccgggcctgagaacgtcgccggcgtgatcatcaccatcacctgcaacagcgccggcggccagccggtggcgatggacaatatccgcgccgccgccgcgctcgcccgcgcccatggcatcccggtggtgatcgacagcgcccgcttcgccgagaacgcctggttcatcaagcgccgcgacccggcctggcgcgatgcggcgctgaccgagatcgtggcggcgatctatgccgaaggcgacgtgctgaccatgtcggccaagaaggatccgatggtcaatatgggcgggctgtgcgcagtccgcgacgacgcggacctcttcgccggcgttcaggcgctctgcgtgccgatggaaggcttcatcacctatggcggcatgtccggacgcgatatggacgcgctcgcggtcggcctggacgaagcggtggacgaggccttcctggactatcgcatcgcccaggtcgcccatctgggtcagcggctgatcgaaggcggggtgccgatccaggcgccgaccggcggtcatgcggtgttcgtcgatgccgcgcgcatgctgccgcatatcccggctgcccgcttcccggcccaggcgctcgccaacgcgctctatgtcgaaggcggcgtgcgcggggtggagatcggatcgctgctgctggggcgcgacccggaaaccgggcagcagaagccgtcgaagctggaactgctgcggctcaccatcccgcgccgggtctataccaacgaccatatggattatgtggccgacgccctgatccgggtgaaagaccgcgcccacgacctcaacggactcggtttcgtgcacgagcccagggtgctgcgtcatttcaccgcccgattggccccggacagcgcaggaccgctgcgccgcagcgcctgacccacggcctcgccgtcggcggcattgttttgccgcttggcggcgcccgcggcacccggcagtctcatcatgcaccggttcccgacccgacagacaggccggccggtgcgtgaccccggagacgccgaccgatgaagaccccccatccgctgaaatccatcgacattgccgaactggcccgccgccatttcggcagcacccccgatgccctggaacccgaagagcgccgggtgctggccggcatcgcccggcacactcatctctcccgcgatgtttcagacctcgccgatgaacaatccggccgctgggaaaggctggctgatcgggtggccgcgatcggcggatcctggggcttcatcctgagcttcaccggcgtgctggtcgcgtggatggtgctcaatgccgggctgcttcagctctggcatctggccttcgacccctaccccttcatctttctgaacctgatgctgtcgatgctggccgccgtccaggcgccgatcatcatgatgagccagaaccgccaggcggcgaaggaccgcatcgccgccgcccatgactacgaggtcaacctcaaggcagaactcgagatcatgcggctgcacgaaaagatcgatcagctgcgcatcgagcacctcgaaaccatttcccgccaccaggccgaaatgctggaactgctgcacagccggatcgagccccgccccggtgccgcgccggatgcggccgggcccgccggctgagccggcgatatcacaagccatcgcttgacatattcccaagcgccacggacaatccgacctgatattgataatgagtcgcaatcttaattgcgacacaccaaaggaccggatcccatggccttcgagcttccctccctgccttacagcaccacggccctcgccgcccgcggcatgagccaggagacgctggaactccatcacggcaagcatcaccaggcctatgtcacggccctcaacggtttcgtcgccaaggatgaaagcctgcagggcaagtcgctggaagagatcatccatctctcggccgggcgcgcggacatggcgccggtgttcaacaatgccggccagcactggaaccacatcatcttctggcagagcctggccccggccggcggccgcatgcccgaccggctgggtgcgaagatcacggaggatttcggcagcctcgatgccttcaaggaggccttccgcgctgccgcgatcagccagttcggctcgggctgggcctggctggtgctgaagcccgacggcaggctcggcgtgtcgaagagcccgaatgccgccaacccgctctcggccgcagacggccgcactttgctcggcctcgatgtctgggagcacagctactatctggacttccgcaaccggcgcccggattacgtgaccaacttcctggacaatctggcgaattacgactttgccgaagcggagctgctcgccgcctgagcctcgcgcacggtctggtccagctcggatttcagccagtctccgagccgggccaccgccgccgacggcaccccccgcgtcccgcgccggatcaatccgtagcgggagccgtcggcggcgaacccttcgggtgccgtcagacgcccggctgcaaggtcgtcggccaccaccagcagcgggcagagcgcaaccccaagccctgcgatggcgctttcggccgccagcacatgatggtcgaacagccggatctcgcgcggctgcggcaccgccggatgcagggccagccagtcggcccagccccgcggccgggtggtggaccccagcgccacataatctccattcctgaaagccgccagttgagccgccgtcgccaccggccccatcgcttcttcgaccaccggctcgacgagccagcccggctcgaccgggaaatccagccgcctgacggccagccccgcgccaccggtgccaagatccggccggccgccaccgaccgacaaatgtacccgcagatccggatgatccgcctcgaaccggccgagccgcggaatcagccagcgcatggcgatcgagcgttcgcaggacagcaccaccggcccctcggccgccccgcggatccgcgccagcgcatcgcccacctgatcgagtgctgcatgcgccgccgcggccagcaccgccccttcaggcgtgggccggatgccgcgcccctcgggctccaccagccgcacgcccagatcccgggccagcttgccgatccgccggctgaccgcgccatgggtcagcaccagctcttccgccgccgcgcgcacaccccccagccgcaccaccgcttcgaaggcgcgcagatcgtcgagcgaggggatttcggatcgtttcatttttgcctgggcttctcaccgttgcttgcgatgcaagcttaggcccgacgagcgcatttccacagcaaaacccgtcagcttttgtcaccagttatggtcggaacccatcgcttttcctagcccgccccgccgctagactgaggccgacaccgcagcagccgcgaaggggcgagagagatgacagagacggcaccggttctggtcaccatgggtgatccggcaggcatcggccccgaaatcatcgtgaaggcgctggcgggtgccgcccggccgctgccggtcgtggtggtgggggacgcccgggtgatggcgcgggcggtcgggctcgtggccccagatatgcggatcgatatcgtcaccgatcccctggccgggacggcgggtccgggggtgatcaggctggtggaaagcggccggatcgatccgcctccgggctttggccggatcgatgccgcggcggcgcaggcagcggtcaatgccgtgcgggcagcggtgcggctggtgcaggcgggacgcggttccgcgatcgtcaccgcgccgatcaacaaggcggcgctcgccctggccgggctgtcctggccgggccacaccgaattgctggcggcccatgccggccgggggcctgcggcgatgatgctggctggcccggatctgcgggtggtgccggcaaccctgcacatggcgctggccgaggcggtggccaagctcgatcacgacaccgaactcgcggcgatccgggccgccgatcagggggcacgcgccttcggcattccggccccgcgggtggcggtcgccgccctcaacccccatgccggcgatggcggacggttcggcgatgccgaggcccggatcctggtaccggccatcgcggccgcacgcgccgagggcatcgatgcctcgggcccctggccggcggataccgtcttccttcaggcccgccgcggccgcttcgacgttgtggtcgcccagtatcacgatcaggcgatgatcccggccaagctcgacgggctggatgccgcggtcaacgtcacgctggggctggacctgatccgcaccagccccgatcatggcacggccttcgacatcgccggccgcggcatcgccgatccggcgccactgctggccgccatcgcctgcgcccgccgcctgtcctcgccccccgccttccgcgacccggccgacagcccaaccggagcctgaccccatgtccgaccgcctgatcttcatggcaacccgcaacgatgccaccgttgccggggccgaaaccctggtcgagaccgcggccgcgctcggcatccgccggatcggcttcaaggatgtcgggctggaccgcaacggtctggcggcacttcatgcccgcatcaaggccgcgggcgccgaaagcgtgctggagatggtctcgctcgatcccgccgccgaggcggcggcggcacggctggcggtcgatctgggcgtcgacctgctgctcggcggccggcattcggacgcggtgctgccggtgatcgccggccacggcctgcgctatatgccctttgccggcgcggtgtccggccatcccagcatgctatcgggcagcgatgacgagatcgtggccgatgccgcccggctgtccgccatggatggcgtttcgggcgtagatctgctggcctggcgccggccgggcgatgcagcggggctgatcgcgaaagtggtggccgccatcacgccgaagccggtgatcgtggccggatcgatcgacagcccggcagcggtgacagccgtggtcgcggctggtgccgccggcttcaccatcggcaccgccgcgatcgagggtagtttcgccggggcggcccccgagctttcagcccagctcggcgccgcgctgaaggcgctggccgaagccgaggggcggatctccgccgccggcaccgtcgacctcgcccgcgccttcgccgggttcgacgattgctggagcccgcgcatcggcgggcggatcaacgacatgcatctgaagctggtcaagctgtccggcgccttcgtctggcaccgccacgaggtcgaggacgagctgttcctggtgacccgcggccggctgctgatgaaattccgtgaccgcgacgaagaggtggcggccggccagttcatcatcgtgccccatggtgtggagcactgcccggtggcgctggacgagccctgcgaggtggtgctgctggaaccggcgaccacggtcaacaccggcacggccggcggcgggcgtacggtcacccatctcaaatcgatctgagccgcccgaccggatcagcccctcagaccaccccgccattggccctgagggtctggccgtcgatccaggcgccgtcggggccggccaggaaggcgaccgcggcggcgatgtcgccgggcgtgcccagccgttccagcggcgacagcttcgccagacggtcgaccagctccggcgacttgccgtccaggaacagatcggtggcggtgggtccgggggcgaccgcgttgaccgtgatgccgcggccgcgcagttcccgcgccaggaccatggtcatcgcctcgacggcggccttggtgccggcataagggccataacccggctgcagcaggccgaccacgctggacgacaggttgacgatccgcccgccctcgcccaggcgccctgccgcctcgcgcatcacgttgaaactgccgcgcagattgatcgcgatcatccggtcgaagacctcgtcggtcatcccggcgatcgggcccagcgtcatgacaccggcattgttgaccaccacgtcgacccggccgaacgccgtgatcgccgcatcgaacaggccggtcacgtcctcggtgcgggcgatgtcggcacggcaggccaccgcccgcccgccggcatcgatgatgccggccaccacctcttcggcggccccggcattgccggcataattcaccaccaccgccagcccgtccccggccagacgccgggcgatcgcggcaccgatgccgcgcgaagcaccggtcacgatcgcaacccgcggcgccgtctgatcctgtccgctcatctgtcgtctcctgcctgagtggccctgggtctgagtggccctgggtaccgcacaagatgcacctgggctcctcccggataatcggccatgattcggtatcatcatccggataaggcgaatgatcagatggatcggtttgagacgatgcgggtcttcagccgtgtggtggagcggcgcagcttcacccgggcagccgaggatctgggcttgccccgctccactgtcacggatgcagtgaaggcgctggaggcgcggctgggcgtgcgcctgctggaacgcaccacccgccaggtgcgcccgacaccggatggcgaagccttccatcagcgttgcctggcgctgatcgccgatctggaggatgcggaggcgtcagttgcggatgcagggttgcgcggccctctgcgggccgatgttcacggtaccctctggcggcatgtcgtgctgccacatctacctgcattcctggaacgtcaccccggtatcgagctccgtgtgacagagggcgaccggctggttgatctggtgcgcgagggcattgattgcgtgctgagggttggtacgccacgcgacggccggctgatcgcccgacgggtggcactgctcgacgaggtaacggtggcaagtccggattacctgtcccgccatggacggccgcgggatcttcaggcgctagacggccatatgacgatcggcttctattccagtgcgactggcggccttttgccgctggagttcacccgtgacggcgaagtggttgagatcaccttgccggcccggctgacagtggacggcgccgagaccctcaccgaggccgcgcggctggggttgggactcatccaggtgccgcgctatcatgtcgcttccgacatagcagccggccggcttgtcgaagtgttggagaattttccgccgacacccacgccggtccatctgatgcatcccgagggacgccagcccgcgccgcgcgtccaggccttcacagcctggcttgccggccttttccgggccgaggcacgccgctgaacagcagcagcgccgccagacccgcgatgatgccgaggcccagcgacagaaccagggcgccctcagccccccagcgcgccatgaccgcagcataggcgacgggggccacggccgaggcggcgaagcccggtgcgatcagccggcccaccgtcagcccgtagcggcggggatcgaacagcaccagcggcagggtcccgcgggtgatggtcaacagcccgttgccggcaccataggcgagcgagaagccgagcgccgccacgaccgaaccgccgcccgcgaggcaggcggcgaaagcgggcggcagcagcaggcaggcgatcaggttcagccgcttcgcatcgctgcgcccccccgtcgtcacctcgcacagccgggccgccgactggccgacaccacgggcggcggcgacccagaccgccgcctgggccccgagccccaacccggccaggatcgcgatcatatgagcggccatgccggccgccagaaaggccgccaccgccatgatcagcgcataaagcatggccggagccaggggcctgcgcgcagtcgggggtgtgcgcgcggccggcaccggccgcaggatggccgggcgaggcccatgcccggccggcagccccagatgcagcggcagggtggcgagcgccagcacggcatagacgaccaccgcaccccgccagcccagcgcctgcatcagcccctggcccagcggccagaaaaggctggacgacaggccgcccagcaaggtgacggccgacatggccggccccgcctgccggccgccgatgcgggcgagggtcgcgaaagcggcgtcataaagcgtgaaggacatggcgaggcccaggcagatccaggccgcgacatagagcaccggcccacgggccgccgccagcagcaggcagcccgcggccatggcgaccgcgcctgcgatcatcacccaccgcccgccatgccggtcgaccagccggccggcgaaaggggcggcaaggccggtgaccgccaggcccagcgcgaaaccgccatgcacctcggccgcgccccaacccagatcggcggcgatcgccgtgccgaacacgccgatcagataatagctcaccccccaggcgacgagctgggccagagccagacgcaggacgatgccccgggcgatcatcggccggcatcgccgggcagggtcgcatccccttcgcccagcgggcgctgcatcagcaccgaattcagccagccgccgaatttgaacccgaccgattcgaaggtgccgacgatccgaaagcccatgcggcggtgaagcgcgatcgagccggcattggccgaatcgccgatcaccgccagcatctgccgccacggcccggcctcgcaacgcccgatcaacgcccccagcagggcggtgccgataccccgcccgcccagatcgggcgccacataaaccgaatcctcgaccgtgaaccgataggccgatcgcggccgataggcggtggcataggcatagcccgccacccggtcgcccagcagcgcgaccagatagggcagatcgcgtgcgacaacgccctgccagcgctcggtgatctcggcgaccgagggcggctcttcctcgaaactcgcccggccggtccggacgtgatgggcgtagatggccgcaatcgcggccatgtcggcgggggtcgcatcgcgcacgaccacccttgcgggggccgcggctgcggcgccctcggtcgtcattctgccgatatccatgacctgggtctttcgggttccgggccgggcgccatccgcgcgccccgctccgtgccccgccatcatggcctgtgcccgtgcatcaaagaagcttctggaaatcatgcagagcatgaggaattcttatcgaatgaaccggctggatctcgactatctgggcaccttcctgaccgtgatcgactgcggcagcttcactgccgccgccgaacggctgggcctgagccagccggcggtcagcctgcagatccggcagctggagcgccggctcggcaccacgctgatcgagcgggtgggccgcaaggcccggccgacggcggcgggggccgaattgctggcccatgcgccgaagatcgacgccgcggtcggtgccgcgatcgaggccgtgtcgcatcacgccgccggcgatgcggggcgcgtgcggctcggcaccggcgccaccgcctgcatcttcctgctgccgccgctgctgggagaactgcgccgccgttttcccggcaccgagatcacggtcaccaccggcaacaccgccgatatcgtcaaggcgatcgaagacaatctgatcgatctgggcctggtcaccctgccggccgcggggcggatgctcgagatcacgccggtgctggaggatgatttcgtcgccatcgccccggccgagatggccctgccggcacgggtgaccgcatccagcctggcgggcctgccgctgctgctgttcgaacccgggggcaacacccgccggatcgtcgacgactggttcgccggtgcggcggtgccgctccggccggtgatgtcgctcggcagcgtcgaggcgatcaaggccatggtcggcgccgggctcggctgttcggttctgccgggcatggcggtgccgggcggcaccctgcccggcatcaccgtccggccgctgtccccccgcctgcaccgtcgtctggcggtggtgatccgccgcgacaagcgcctgacccggggcctgcgcgcggcggtggagaccctgcgggatctggcggccggtcaggccgccgcgatcgccgccacaagcgcatcgacggggccgaacagctgaccggcatcgagcagccgcgcgccggcccctttgtccaggatcagtgccggaacgccgtgcacacccattcggcgcgtcgcctcgcggccggccgcgatccgcgcccggtctgccgccagcaatgcaggatccggtgcctggaaccgcgcggccgccgtggccatgcccagcccgtccaggacaccggcaatgaccccgcgatcggcattgtcgagaccgtcgacatagcgggctcgctggatcgcctccagcgccgccagctcctgcgtcaggctctcgccggccggtgccgcaagacgcacggcggtcagggccagagtggccggccccgaatcgacccggccacccgtcgcccccagcacctggcggcgatagctctcggtgaagggctggcccgagagccgggcgatgcgctgatccgcagcccaggcatgggctccgaagccgtcattcatgggaaaggcgccgctgccagcgaacagccccacggggagcgggtccagcgcaataccggcctggccggccaggcggcggatggcgggcgcggcaccgtagcaccagccgcagagcggatcgaacagccaggtgacggacaccgcgccggccatgtcagtagcctacggtgaagcgctggcggatgtgcttcggcgtctcgatctcgtcgaccagcgccacggcgtaatcctcgaacgagatgctgctgccgccctcgcccaccagcagctggtcggtgccgagacggaaagtgccggtgcgctcgccgggcacgaacatggccgccggcgacaggaaggtccagtccaggtcgtcgatgccacgcagaatgtcgaggaattcggcgcccttgctggcctcggcatgataggcggcggggaagtcgggctgatcgaccaggcgcttgcccggcgccacctccaggctgccggcaccgccgaccaccagatagcgcacgacacccgaggcgcgcacggcggcaatcagcttctccgggtcgctcgccaggaaatgaaccgagctgatcaccgcgtcatgacctttcaggatgtccgccagtccgttgacgtcgaagacgtcgcccgcaactgcggtcacgcccggcagggcggcgatcttctcagggtgccgcgcgatgccggtcaccaggtggccgcgatccgacagctccttcaggatgcgcgcgccggcattgcccgaggcgccgatgagggcgatcttcgccatgattgagggatccttccgctcggatatggagggtggtcttcattcaagacccggtccggaaagtggaccgtggatccgaggtatgctacaccctgatcccgcgcaagaagtcatcttcgcgtcatctggtcactgcggcgtgacctttgcgtccttccgggagaggcgacatggcaatgcagaccgccgaaaagaccccgcgcgacgacccgccgggcccctgggaccgccccgcagacgagccctgcccgatccgcgacgtgctcgaccggatcggcgaccagtggagcatgctggtgctctccgccctgtgggagggcacgaagcggttcaacgagctgggccgccagatcggcgacatctcgaagcagatgctgtcgcgcacgctgaggcgcctggaacaggacggtttcgtgcgccgaaccgtctatgccgaagtgccgccccgggtggagtacgagctgaccgatctcggccggtcgttcatggtgccgatgcgggcgctggtggtctgggcggacgacaatcacgcggccatccgcgccgcccgcgacagctatgagggctgatcgccacccgttccccttgcgatgagcgcgagcaggatgcgcctgagttccgtctgcgcctcctccggggtcagatcgcccgcgacggccgcatccgacagggcgtccgccgcccccagcatcgcccagagcccggcggcggacagatctccgtccggcgcgaagggaccgagcaactgccgacaggtttccagaaaggtgcgctgatagtcccgcttcagcgccgccagctcgggtgatccggcaagggcggcgagcacgcctgggatctcgcgcccctgggccgccacgcaatcgacatagcaggcggcgatgatccgcgcccgatccgcagccgtgggggcgcccgcctccagcgctgcggtcatcgtggcggtctggcgggcgtcgaaatcgcgatagagcgcggtcagcaagccctcgcgggtgccgaaatgatcatagaccaccggcttggtgacacccgcccgctcggccagccggccaagggtcagagcatccgtgccctcgtcgcggatcaccctccacgacatgtcgagcagctggcgcagccggtcctcgcggctgaggcggcggcggggtgtggaagagcggtcggtcgggacgcttgacatggcctatgtaccaaaagtaacttactaaaagtatataacagcagcccgcgatctgcaatccatccccctcggcccccatccatctgcaccggagagcacgccccatgcatgcgctcatcgtcctctcgcatcccgatcccggctccctgacccatgccgttgccgcccgcatcgccgacggcgtggtcgcggccggacataccgccacccgcgccgatctggcggccgaaggcttcgatccacgcttttccgacgccgatctcgccgcccatcgcggccggacggcgatccccgacgatatcctcgccgaacagcggcggatcgatcaggccgatgccctgatcctggtttatcccgtctactggtggtcgatgcccggtctcctcaagggctggatcgaccgggtgttcagcaatggctgggcctatgacgaccggccgggcgacgggatccgcaagctgctgggccggctgccggtgcatctggtggcgctgggcggtgccgatctgcggacctatgcccgccacggctatttcggcgccatgcgcacccagatcgaccacggcatcttcgactattgcggcgcgccggtggcgaccaccgagctgatggtcgacaccgatcccggagagacggccgccgcccatctcgacaccgcccatgccctgggccgacacctgttcaacgacgcgcgcaccacccgcgccgcctgatcgcgcctgcctctcgacaccgacgcgcgacatgcccgaggatagctgcatcccccggtatcttttacgcagaggagagcaggatgacgacgcggttcgtgacacggctggcgctggccgccgcaaccttcctcgccgcgggcggcagcgcgctcgccggggagggttcgctgtggaaggtctatgacgagagcctgaaatcggcgaaatacatcgacctcacccatgccttcgcgccggtgcagccggtctggccgggtttctccaacgcgaagttcaggccggcggtagccggccaggacattccgggctatgtcgcaaagggggaggaattcacctacgataagcacggtttcgtcgcctcggcctatgacctgaccaccgaccagtacggcacgcagctcgacccgccctcgcactggaatccgctgggtgccacgatcagcgatctgccgccgacctatgccgtgcggccgctggtggtgatcgacatcagcggcaaggtggcggccgatgaaggctatcacctccagatcgccgatatcgaggcctgggaggcgaagcacggccgcattcccgaaggctcggtcgtgttcgtgcgctccgactggtacaaaaaatggagcgacacagcgcgcttcaaccagaagcccttccccggggtcgggctcgatgcgctcaaattcctgcacctggaacggaagatcctgttccacggtcacgagccgctcgacaccgacaccacgccgacgctggagggcgaacactggctgctgcacaatgatttcgtgcaggccgaaggcgtcgccaatctcgacaaggtgcccgaggcgggcgccctggtcaccatcggtttcgcaaagcccgaaggcggttccggcggcttcgcccgctatgtcgccatcgccccggcggactggccggagggggtgacgatcgccgaggcgccgggcgcgccgctgccgcgccagccggcaccgctggtacgcgacgaaaacggggtgttccgcccgaagccgtgacccggcctcatccctgacccgccctcacccctggcgcggcaccagctgccagatccgttcgaccacctcgctcaagcccttgagaccgcgctcgaccggcgcggtctcaagctcctgaacgtggtagtccgcgccgtagagcgcgtgaacctcgtcggcctgcaccgaaaagggggggcccttggcgagggactggtcgtattcatagctgatcagcagctgccgtgcgccgccggtcaggccacgcagatggccggcatagtgccaccggacatctcccggcagggcgaccagcgccgcacggtcatagatcgcatccaccggccccagatgcgccggggtgagcgcgaagacgtcgcccacgaagatgtcgataccggcggcggagaagcgctccagcggccccgccgccgtcacctcgggggcaagctccagctcggcgaaaagctgctcgatcgcgctgcggttcaactcggcaccggcgacccgggcgccccgccccatcagccaggcaatgtcgcgggtcttgccgcagagcggcagaaagacccggctgcccgcccccgccgccagacggtcggcatgcctcaccaggaaatggttggggcggccttcatggaagccgatctcgttgcgctgccacttgccgtgccagaagtcgggggtcatgccgcataccaccttccgtaagcgtcgggatctgcgtcactctagtcgcgacgggtcgcggacggaaggtgcacgggatgcaggatgatgctgcaaccggcgcctgccgatggacccaatggatggggaggccgccatggagatcgatgccgaccggctgggccgggcactcgccgccctggggcgtgccgatgatccccagggttttgcgaccgccggcacgcggtcgctggcagctctgttcgatgccccgcgcgcggtgctgtccctgcgggacgccgatggtggagagagccggttcatcgcctggcccggctggtgcgcgcagacctatcgccggcaggtcctcgcacaggatcccatccgcgcctggctggatggctgccgccccggtacggcgccggtcatccgcctgtcggatctggtgcccggacgcgcgctggaacgtgcgccctatttcgaaaccctgctccggcccacgggcgcgcgccatgtgctgaccctcgccatccgccgcggcggacggatcgccggggcgctcagcctggtgcgcaaccaggacgcccccgacttctcgatcgaagaccgcaacctcgccacagccctggtgccggcgctggagatgagccatgcgctggcccatcgccgcatgcccgccgccgcacagccattcaccgcacgagaggccgaaatcgcccggctggtggcggatggcgccaccaacaagatgatcgcccgccagctcggcctcagcccggagacggtgaaaaaccatctgcgggcgatcttcaggaaggcaggcgtcgccaaccgcaccaccctctccgcctggatgctcagccgcgcgccatgatctccgccgccgcctgcagccccgaccagtgggcctggccgacggtgctgttggtcagatagtcgccgcagaacgccacccgcggcagcggtcccagatcccggaaggccttgagccgggtcacgaagcccttgggccgcttgcagatcgcggccggctggcgcgaaacgaaggcatcgatcagccgcgtgccggccagccccggcaccgcctcgaccatatcgccccaggtgatcgcgatcaggtcgtcatcggtggcatcggcatgctgccggcagccggcatccttccactgggcatgcgccagggtggtgccgtcgccgcgatcggtgaagcgcatattgccggtgcgatggaagccgtcggccgccggcagaacataggtgtcgagcagatcgcccttgggccggtccagcaggtaatagacgatgtggtggccggcatagtcgatcgcctcgaagaagccgcgccgcccggcatccagatccggcatcagcccggagaccagatggccgggcaccgccatgatcacggcatcggcgcggatgacctccggcgcctcgtccgcccggctgtacgcaacctgcacgccgtccgcatcatggcgcacctcgtgcacggtgcagccggtgcgatagtcggtgccgggatcggccgcaaaggcccggcccaacgcccaggtcaaccggccgacgccacgctcgcgatagctccacatatggttgccggcccaggacagccgcccggccgaactccaggccgtccaggccagggagaaatcctcagcgccatagccgcagaacatgcccatgcagggttcgaggaaatagtcgacgaaggcaggtgagagacgccggaaatgctcgcaggcattgacgtcgtccagggccaccacgctggtcaggtcgcgcggatcggccgccagcatccgccgggccagctgcggcagggccaccaacagccgggccttctcggcaaaggggatcgccggatgccgggcggcgctcatcatgtcgaaggcgccgaaatccgccacctcgcggcggcggatcagtacgttccagcgatgggcggccgtcaggtccagcaggtcttccggtgcatgcagccccagttcacgcgacagatcggcgagattggtctcggcgcccagaaaggcgaaggccccggtcggaacccaggcgccctgccagaacaccgaccggcagcgcccgcccggctcggccgccttttcaagcagcaccacctggtgcccctcggccctcaaccgccaggccgcacccaacccggcaatgcccccgcccacgatgatgacccgcatggctccgcgccctccgtccgatcattgcaaccgggctcagtctggaagggcgtgcgggccggcaccatgacccggacgggtcatgggctcagtcctgaacggtcggccggatcaccagatcgccgatatcgaccccgtcgggctcggcgatcgcgaaggcgatgctgcgggcgacggcatcggcatccaggccgatctccgccatccgggcctgcatgcccgccatcacgccgggatcggacatcgatgccgcaagatcggtgcgcacgaagccgggcgaaatgccggtgacgcggaaatcaccgcgcgattcctggcgcagcccctccattaccgtgcggaccgcgttcttggttgccgcatagacccccatgcccggcacgatgcgcagcccggcggtggagatcaccgtcacgaaatggccggatgtctggcggcggaacaccggcagtgccgccgcgatgccatagagcacaccgcgcagattgatgtcgatcatccggtcccagtcgtcgaccgccagatcgtcgaagggaccgatcggcgcgacaccggcattggagaccagcacgtccagccgcccgaaacgttcctgcgccagatcgaccagacccgccggcccggcgcgcgtcgcgacatccgccgccatccagacgaccgtgccgccatcggcggcaatcgacgcggccacctgttccagccgcgcggccccccgcccggccagcaccagcttcgcgccgcctgccgccagccggcgggccgtcgccgcgccgatgccgctgccggcaccggtcaccaccaccaccttgccctcgatcccatccgtcatcgcatcgcctccgtcatcgcatcgcctccgtcatcgatcagcttccgagacgctagccggcagctttcggtgttgctatgagacaggatccagagtttcggcgagatcgtccaatgtcgaccgaccccctctccggcatcctcggcctgctcgacgtgcgcggggccgctttcgtgcggctggaagccggcggcgactggtcgctggccttccggccccgcccgctggtcaagttcaacgccgtactgcgcggccgatgctggctgaccctcgatggcggcgaaccggtgcagttgcaggcgggcgatgccttcctgctggcccttccccccggctatacggtcgcgagcgatccggagctgccgccggcggacggatcggcgctgttcgccgccgccgcgcgcggcagcgtcacctgcggcggggacgaagtggtgctgatcggcggcagcttcaccatcgatcgcccggatggcgagctgctgcacgggatcctgccgcccttccttaagatcgacatggccgatccccgcgcggccggggtgcgggcgaccctggcacggctggaagccgaacttctggccggggatctgggggtggatcttgtggcccggcgcctggccgaggtgctgctgatcgacatgctgcgcgcccatgccggccgcgcgacggaagagggaggctggctgctcgcggcgcttgcagatccgaagatcggggcggcccttgccgccatgcatgccgctcccggccgcgactggacggtggcagagctggcgcggcttgccgccatgtcgcgatcgggctttgcccggcgcttcgccgaggcgaccggcaccacgccgatcgaccatcttctccactggcggatgcgcctggcccgggcggcgctgcgccggggcggcaccacgatcggtgccctggccgaacggctgggttatgcctcggaaagcgccttcagcacggccttcaagcgcgtccacggccgcgcgccacgcggctgggcgcaggagaaccgcgcaaccggcggctgacggctgacggatcacccatcgcctttgtcgcagggatggtgcaggctgcgggttcccgtccctgccgccgccccggacccagccgcgtgccccttccgccgaacctcgccccgaaccttccgccgatcctggccccgcttcgcgccgatgcccgctggtatgcgaccggctatctcgcgatgttcgcctcgtccttcgggcagacctttttcgtggcgctgtcggggaacgacatccgggcggcgttcagcctctcggcgggcgatttcgggctgatctacaccgccgtcaccctgggcggtgccctgctgctggcgctgaccggcgggctggtcgaccggatgccggtgacgcgcgtgctggccttcaccctgcccgccttcgcggccggtgccgtgctgaccggcacggcaactcaccttctccagctgatcccgggcctgctgctgctccgcttctgcgggcaggggatgatggtgcatctggcctataccaccatcggccgctggttcgcggccgggcgcggccgcgcggtctcgattgcagcgcttggcctcaacaccggtcaggcgctgctgccgctgggtcaggtggtgctggcgggcgccatcggctggcgcctcggctggatcgtcgcggccggccttgttctgctgctctggccggtgctggcccggcttgccgcccgcgaccggcagccggcggcggcggatccggccgcggcggcgcccccgatccgccactggtcgcgggccgaggtgctgcgcgatccctgtttctatctgctgctggccggcatgctgccgcccgccttcatcagcaacaccatcttcttccaccagaccagccttgccgccgcccgcggctgggcgcccgaggtcttcgcctcggccttcaccctttatgccgtgatcgcgatcggcaatgtcctgctgtcgggccatctgatcgaccgggccggcgcgcggcgcctgctgccggtctatctgctgcccttcggtgccgcctgccttgtcctggccgtcgtcgatgcgccctggtctgccttcgccttcatgctgctctacggcatcaccgacggcatctcgctcacccttttcggcagcctctggcccgaggtctacggcacccgccatctgggcgccgtgcggggggtggtggtggcggccatggtgctggccgccgccgccggcccaggccttgccgggctgctggtcgatgccgggattcccctgccctggctgatcgccggcatggggtgctattgcggcctgatctgcccggtactggtgctgaccgtccgccgggtctcggcccggctggcggatcagaaggtgtaggccaccgccgccttcacgctgcgccccttggccgagaagccgttgaaataggccttgtagtccttgtcgaacaggttctgcaccgtcagccgtgcggtcgccccgccgaacaggccatcgcgcggcgtccagctgacatagacgtcgtggacaccatagccggcgctggccggataggggctataggggatcagcgcatcatccgggatgtcgtcctggccggcgacgaacagccccttccagccgaccagcaggtcgtattccgggatcttgcgaccgaactgggcgaccagcttgaacggcgcgatgtcgtagaccggctgatcggcgccatagatgtcgcgcaccgatccctcatgctcgccttcggcataggcgaggctcaagccggcgatgtagagcgggctgtcgtagaaggcttccagctccacgccctgggtataaaagccgcgcagattgtgatggctcggcacccgatcggggtagcggccgacattgggcgagccgaacacccgcatgatgttgtccgacacgtcgttgcgatagatctggacccgggtcagcaccttgtccttcggctccaggacatcgccgaaggtcagcaccgcgcctatccgcttttcgaaagcacgctcggcctccagctggcgcgcggaggaccggttggtgccgacctcgtagatctcgtcgaccagcggtgcgcgcagcttgtaggcgagcccgccgaacagcgcgagattgtcgttcacctgatagagcgcgttcagcgtcggcgaaaagcccttgtgcaccaccgccgaatagtcgtgccccttggcggggtcgcggtaatcggccgcggcattgggcacgccgtcggtgcggatatggtcgtagcgcaggccgggcgtgacggtcagcccgttgccgaaatcgacctcatattccatccagccggcatagatcgtctgggtgccggccggaatgttatagggctgaagatggccgtaattgcggtcgggatcgttccggtccgtccaggaataggccatgctgtcacggtcctggtgcttcacctggacgccgatgttgagtgtcgtatccacgccgccgaccgtaaagcggctctcgttataaatctcggcgccgtagttctcgtaagacagccagctttcattgccgccaaggcccaggttgacatagatgtcctcgacctggcgcttatcgtgctgtttcgtctcggaccacgacagctgcacggtggtgcggaccagcggatcggccgggtcgtagacatatttgcccgacagcgagcggtcgtcggtctggcgccgcacggtcagccgggccagcgcctgttcgaaaccgtagcgatcgatctgataatccgacggcacgatctgaccggtcttggcggcgaaggggccgagcacgtcgctggtcgacatggcgccgctcagttccaggaaatgatcctcgcgcgcgacgctgcccttgaaatggccgctcagcaattcgccttccgacaggttgagcttctgcccgtcggccgttcggtacttgtcgttgtcgcgccgggtggccgagaccagcagttcggcgccgctgtcgtcgtcacggccgaaaagcgcggtggtccggctccattccttgccgttgacgccatagccgagcttcaggaagccgccggtattctcccccggcagcagcatgtccgaggcggattttgtggtcagcgccaccgtgccgccgaaagcgccatagccgcggggtgagaacgagcctttgtcgacggtgatctccttgaccagctccggctcgatgaacaccgtgccctggcgatatttctcgaagctcttgtcggcaccgtcgagcgtgatcgccacatcctcctgatcgccaaacccccagatgttgagcgaatgcccgtcgggcctggccgagccgaccagatcgacacccggcaggtcattgagcagttccggcaccgaactggcctggagccgctcgatcgtctcccgatccaccgtcgatgtcgcgatggtgcggacatcggtcagcgcgctgatcaccaccaccgggtccagcctctgcgcccggctctcctgtccctggccctgatcggccgccggcaccagggtgaccaggccgccctctcccgtgcggaaatcgacgccggtgccctccagcagcgccaccagcgcctggatcgcatccatctcgcccgtgacacccgggctggtccggccggcggccagagaggggatgtacgagatctgcagcccagattgctggccgaaaacctgcaatgcctgagcaagcgggccggcaggcacggcatagccgcgctccgccgcgcgggcaaccgcaatgcccggctggccgggcagctggccacccgccaccgccaccaccgcaaccgacatcatcagggcccggcgcagccgccgtccccgtcctccaagaccagccatcatcacgtccgtccgatcctctgtgcagcagatcgggcgcaggcctggcttgcatgccattgcaccgcaccctcctgtctgcccagacggagtccggcgccggatttgaaccccttctttgcgaattattttcaatcgcaatatgggcgcgccctcacgcccggtcgatcaccatggcccaggggccgatccggcgcagccgcccgccataggggcggatcaccgcccgcgccgccgcctccgggtcggtcgcggtatagacgccgctgatcggcatcgcgcccagatcgtcatccagcagcacgatccggccgtcataccagcgggcgatgcgggcgagcaccgccgcgaccggctccccctccaccaccagtcgtcccgtgcgccaggccgcgaactgccccggggcgagccgcccccgggtcaccgtgcctgtgccgccgtcgatcatcaggcgatcgccggcggtacaagcaagcggggtgcccgcgcccccgatctgcacccgcccctcgcccacgctcaccacgctgagcgcgccctcgacggccagatcgaagcgcgcgggcccagccacactccgcagggtcaggccgcccgtggtcacggtgaagggggccgtccccgccggctcaaaacaggccagaccttcgcgcagagcggcccccggtgcggccgtcagagtgacggcggtcagcggcccgatcgtggcctggccgccgccgggcaggtcgatccttcggatcgcggccacatccgtccgtgtcccggcggtcaaccgcggaaccagggcaagccccgccaccccggccgccattgccacaccgccggccagaacggcgcgccgcccgatccggcgagcgggaggctgcgggatccggccggccgcccccacggcccggccggtcagcgcatgcagctccagcgcctcgcgccagatgccgtcatgaaccgggctccgcccccgccattcggcgatcagccgcagggtcaccgggttgtcgggggcgttctggcggcggatcagaaggtcgaaagcctcctgccagagcgtttcgcgatcaggcggcgccgtcgtcattctgcgtgctcgtccagccggcgtttcacatggccataggcatcgcgcaccatcgcccagacccgggcggtcgacacctccagctcggcggcgatttcggccaggctgcgctcgcccagccggtgctgttcgaaggcgcgccttgtgcgcggcggcagttcggcaagggcggcttccaccaccgccagccgctggcgggccgcggcggcacgctcggcatccggtgcctcgtcggcgatctcgtccagcagagcgggcgacagctcgaccagggccgcccccggctcacgccggtgccggtcgaccagaaggttgagcgcgatgcgtttcagataggcgcgcggattgtgcagcaccgtcgtgccgccaccgcccgcaagcagcttcacgaacacgtcctgggtgatgtcggcggcaacatccgccgaaacgccgcgggcgcgcagggatgatccgatatccgtcgcatgccggcggaacagggccggtagatccatgggctccgatgccttcgtgtcgcggacgtgcatccacacccggcccgccatcgggcggccggatcgatgcagcgtcggtggaggcgacacgcccccgcacacaggataaaccggcagcgacaaaggtccgggccaggatccccgggcgacgggctgggggcggaacggatcggccacaggcgcggcggctggttctttatgggggcccgcaggcccggcgcggagtgtagaccaggatgcgccgggccgccagagatgcccgtccgtgaggtcaggcgaggcccagcttgccgcgcagcgtcgacaggtcttcggccagcgtgttcacctttgcggccaggatccgccggtcagcatcggtcagcttctcatacgagacgaagccgccacccgacattcggtacttctccagcaccttgccggcatcggcgaaattgccgtcgacgcgcgctacgaaatccttgtcggcgatcagcggccgcagcaggtcgtagatctctttcgagccggcgaaattggcgtcgaaatcccagagatcggtatggctgtagcggtcttcctcgcccgaaatcttggtcgcggccacctcttccatcaacgccgcggccccgccgaccaccacctccggcggaaaggtcagcgcgttgatccggttgttcaggtctttcacatccgccagcagccggtcggcatagccctccaggccgcgggtgctgccggtttcccaaagcccgtattcgatccggtggaagccggtgaaggtctcgtccttttcgcccttctcgtagtcgtcggcgcgagcgtcgatcgacccgtcgagatcggcgaacagctcggcgatcggctcgatcttctcatagctggtacgggtgggcgcgaacagcgccttggccctgtcgagatcgccggccttgatcgcagccaccagggcttcggtgtcggtcacgagctggtcggtgttctcggcgacatagatcttgtactccgagagcgggccgacgagatcgagcgacgggtccgccgccagcgcggccggcgcccccaccgcggcaaggccgagcacaagagcaccggtggtgaagagctttgcagccatgctgcctcctgcatctgtctgaagggatgtgactcgacagggcgatcaggcctgccgggcggcctggatcagcgatgatccgacatagtcgtcctcacccgtggcaccgggcggcacgaagaaatacccgccaccgatcggcttgatgtattcctccagcggttcaccgttcagccgcgtctggacggtgatgaagccctgttcaagatccgactgatagcaaatgaagatcagcccctgatcgagctgaccgttcttcatcacgccgcgcgaatagttgaacggccgccgcaggatcagattggcggcgctggccggcgtgcgcggattggcaaggcggatatgcgaatcgagccgggtcttcgctccctccggatcggcggcataatcgggcacgtcatgctccgtcgcccccggcccgccatccagcggcgcgcccgtcaccttgttgcggccgaagatccgctcctgttcggcaagcggcgtgcggtcccagcgctcgaccatgttgcggatgatccgcaccgcctgatagctgccgccccgcgcccagccgggctcgccggcggcactggtccagaccacccggtccatcagcgcggcatcccccgaggccggattggccgagccgtcacggaagcccaggaagttgcgggcgctgggcgtcgatccgtcggcggcggcggcgaccggcggcaccgagccttcgaccatccagcgcagcaccagaaaggcggacaggtttttcacgatgtcgcgcagcgcgtggatattggtgtcctgggtgttggcgcagaactggatggacagatcgccgtggcagaggtccgggtccagcgcgtcattggggaattccaccatccgcgtcagcttcgcgggcgccaggcccgccagccagggccgcgcgaacagcgaggcaccaagcccgatggtgatggtcagatcatccggcgtgaccaccggccccagaatgcccgaatccgccggcggcaatttcggatcgcggtctgcaaccggcccgcccgcggtcagaaaggccgcccgcgcgctcaacgccttcagcatccgctccagatcgtccagcgacatggcgaccacgtcgaaggcggcgatgatgccgttggccgggcgcggggtggtgatccccgcctgacgggcgccgtagaacggcacccgcccctgcatgctgcccggatgggcgcggggggcgtcatccacccggggcgcggagaccgccgcggcggccggccgtgccggacggatcagcgcgcccgcggcagcgcccaccccaagccccatcaacaggctgcgccggctgggtccggccttctgcttcaattctgcagtcatctcaactcatcccgatcacggggggcagcttgcccagcgtcgtcttcagcccggccagatcacgggtcagggcagcgcgtccctcgtctgccgcggcaggcgtggcatcggccttgcgcaggcgggcgagatcgcccgccacccggtcgagtgcggcggtcagctccgcctccagcgcgggatcggcaaccgagacgatctgccccagcaggccggtcagcttggcgatcccgtcgaggctggcttcaagctcagccagatgacgctcgtccagatcctggtcggcaaaggctccctcggcggcacccggccgggtctccacgatccggccggtcatgtcggccggcaggaccagcagcagggccggcgtcacctcggtggtcttcagccgctggttcagggtttcaagatccgcgaccagtcgatcggcgaccggcagcagcccctcgatactgccccgggtgaagagcccgtattcgatgcggtgatagccgatgaagccggggtcggcctcgcgcccggccagataggccgcctgcggatcgatcaccgcctgcaaatcggcaatgcgataggcgagcggctcgatccggcgccagggcagccgcgcggccatccaggcccggcgcgccgcatccaggtcaccggccgcgatggcatcgcgcagtgccgtcgcggccttcaccgccgcccggccctgcatcaccagatagacccggtattcggcgagcgggcccaggaactgccgcagcgtcacctccgacgccgcagccgccgcctcgtccgaggccgtcacatgcagcaccccgcgcgggctggacaacagcccgcaggtgatctcgtaatcgccgggggtgagctgcacggtcagcatctggtggaagcccggcacgatgttctcgcgctcggccaccaccatcaccccgtccaggatctcccattcgatcggccggtccgaggcattcacgatctcgaaactgcgccggccaccgggcagggtgatggtctggggatcgcagcgtccgccggtgacggtgaccacctgatcggcggcccgatcaggacccgcctgccggctctgctcggtcgcataccagaaggcagcaccaccggcgagggcgagcacggcggcacccgccaccgccagctgcatggcacgagaggtttcgggtccgctcatctcacccctcccgcgcgaccgggcgtgccgcagccacgggggcggccggcctcaggaacaggatcagcgtcaccgccaggaaggccgcatagaccagcacctcccccaaagtcggtgcctcgcgatagccgagcagccccgacagcaccgtacccacggcccccgattccggcagcacccggcccagatcgtagaccacgccctgcagcccgttccacagccccgcctcgtgcagggccttcagcgcgccggccagcagccccgccgccacgaacaggatgacgaccccggtccagcggaagaaacgtgccaggttcagccgcagcccgccgcgatagatcgcccagccgatccccgccgacaccgcaatcccggcaagcgcgcccagaggcgctgcagcatcccggctctgctgaaagatcgccagcaggaagaacaccgattccagcccttcccgcgccaccgcgaagaacaccatgccgatcagcgcccagccggccgcacggccaccctctgccgccagcgcctgatcgatgccggcatgcagctcgcggcggatcgatttcgccgcccggcgcatccagaacaccatcgccaccagcacgaccacggcagcgatgccgaccacggcctcgaacagctcctgtgccttctgcggaaagccggcgctgaccatctgcagggcggcgcccgtgaacagcgccatggcggcggcaaggaagatccccacccagaccgcaggcaactggtcgcgccggccggtctggcgcagatagccggcgatgatgcccacgatcagggccgcctccagcccctcgcgcagcatgatcagaaagggtgcgagcatggaattgccttctctgcgtcccctgcccggccccgtgcccttgcccggtcaggcagggcaagggcacggagcggtcggccggccgctcagcaaagggagcagccgacatcggaccgggcaggaaacggatgggatcggatggaaaatcggcgccagcgcaccggccagggccgcaagcggcccggcggaaccgtcggtaatcttacggcgcttcggccatgccgttcggcaccgagcgcccatcaagggtcggcacaagcggtgcagcggtcatgacggtaatggccggggatccggtcatcatggagcacagcggctcgaacatgcggacggccttcttcgatcatccagatctgccggagccccgaaccgggccttcgacacggctggggcacagtcttccacagctgagacgcattcgcaaccgcggtggtgccccctttcccgtttcgggacgaggacggaacgggacaggaaagaagatcgccgggcccctgcccaatgacatccggccccgctggcccccctgtttttgagggggccccgaacgcagcaacgccgcccgcggcgagaggccggggcggcgtttgcttgaaacttggttgcgggggcaggatttgaacctgcgaccttcaggttatgagcctgacgagctaccgggctgctccaccccgcgtcagggcgtaggcggttggcagtgtggattgagatgagatcgcgctttgttgtggtgagcgttgtctgtccatccatgcggttacaagacctggcagcgacctactctcccgcgtcttaagacgaagtaccatcggcgcaggacggtttcacggccgagttcgggatgggatcgggtggttcacgtccgccatagccaccaggtcatgaaaccgcacggagggacagtccggaagttgtgcttccggaagctctgagcgcgagatcgtctgatttgatgatgtgtgtgcaagcttcgtgggccgcgggcccggttctgggcgcggcggggatctttcgagccgatcgagcgattagtaccggtcagctcagcgcattgctgcgcttacacacccggcctatcgacgtggtggtcttccacggctctcaagggagacctggttttgagggaggtttcccgcttagatgctttcagcggttatcccttccggacatagctacccagcgatgcgactggcgtcacaactggtgcaccagaggtccgtccatcccggtcctctcgtactgaggacagatcctctcaagtctcctacacccacggcagatagggaccgaactgtctcacgacgttctaaacccagctcacgtaccactttaatcggcgaacagccgaacccttgggacctgctccagccccaggatgtgatgagccgacatcgaggtgccaaacaaccccgtcgatatggactcttgggggttatcagcctgttatccccggcgtaccttttatccgttgagcgatggcccttccactcgggaccaccggatcactatggccgactttcgtctctgctcgacttgtcagtctcgcagtcaggcgggcttatgccattgcactcgacaaccgatttccgaccggtttgagcccaccatcgcgcgcctccgttactctttgggaggcgaccgccccagtcaaactacccgccatgcagggtcccggctccggatcacggagcgcggttagacaccaagaaccaaaagggtggtatttcaaggttgcctccacctcggctggcgccgcggcttcataggctcccacctatcctacacattcagtccctagtgccactgcaaagctgtagtaaaggtgcacggggtctttccgtctgaccgcgggaactccgcatcttcacggagaattcaatttcgctgagtcgatactggagacagtggggaagtcgttacgccattcgtgcgggtcggaacttacccgacaaggaatttcgctaccttaggaccgttatagttacggccgccgtttaccggggcttcgattcagagcgtgaacccctcctcttaaccttccggcaccgggcaggcgtcagaccctatacgtcgccttgcggcttcgcagagccctgtgtttttagtaaacagtcgccaccccctggtctgtgccccccgcccctggttgcccaggaacggggcccccttctcccgaagttacgggggtaatttgccgagttccttcagtatcgttctctcaagcgccttggtatactctaccagcccacctgtgtcggtttcgggtacggtctgtacgtgggagttatttcctggaacaacttcgctgccgggaacaatccaataagccccgacaacttacatcatccgtcacttcccacaggtgcaggaatattaacctgcttcccatcgactacggctttcgccctcgtcttaggggccgactcaccctgcgcggattagccttgcgcaggaacccttgggctttcggcgacagagtttctcactctgtttgtcgctactcatgtcagcattctcacttccgatacctccaggcgccctcacgggtcacccttcacaggcctacggaacgctccgctaccacgcaccatacggtgcatccacagcttcggtgtacggctttagccccgttacatcttcggcgcgggacagcttatctagaccagtgagctgttacgctttctttaaaggatggctgcttctaagccaacctcctggttgtcatggccgtcctacatcctttcccacttagccgcaacttggggaccttagctggtggtctgggctgtttccctctcgactacggaccttagcacccgcagtctgtctgccacgctgtactccctggtattcggagtttggttaggtttggtaagccggtgaggccccctagcccatccagtgctctacccccaggggtaatcacgtgacgcactacctaaatagttttcgcggagaaccagctatatccgagtttgattggcctttcacccctagccacaggtcatccccgtctttttcaacagacgtgggttcggtcctccagtgcgtgttaccgcaccttcaacctgcccatggctagatcacccggtttcgggtctacttcatccaactcaaacgccctgttcagactcgctttcgctgcgcctacacctatcggcttaagcttgctggataaagtaactcgctgacccattatgcaaaaggtacgccgtcaggcttgcgccctccgactgcttgtaggcatccggtttcaggaactgtttcactcccctcgtcggggtgcttttcacctttccctcacggtactggttcactatcggtcgtcagggagtacttaggcttggagggtggtccccccatcttcgaacaggatttcacgtgtcccgctctactcaaggatccagtgcgcaactctccatacggggctatcacccgctctggccggcctttccatgccgttctgatcgtcgcacaaaggaccactggcctgatccgctttcgctcgccactacttacggagtctccgttgatgtcctttcctccggctacttagatgtttcagttcaccgggttcgcctctcctggctatgtattcaccagaagataccgccgaagcggtgggttgccccattcggaaatccatggatcaaagcttactcgcagctccccacggcttatcgcagcgtgtcacgtccttcatcgcctcctgacgccaaggcatccaccagatgcccttctcttgctcgagagatccgccgccacgtccagaaccggacccgcgatccgtttgcactcctgcaaaccggcgcggtcatccttcgaggttccgacgcgcggccactcagctcgcatacatcagacgatctcatctcttcacactgtcaaagaacatcgccggtgatccaaaaggatcccggttcacggatcggaaacccgatcccggcatcccgttccgaagaacagggccgaaaccttctcgcttcctgcatcgaaccaacgtcaagggcccgtctcaaggacaggtgcctccaggacaagcaaggcagatggtgggcccgggtggactcgaaccaccgacctcacgcttatcaggcgtgtgctctaaccacctgagctacaggcccgcttgactgcgttcgatgcggaagggatgcggggacggcgggcgtcttccttagaaaggaggtgatccagccacaggttcccctacggctaccttgttacgacttcaccccagtcgctgaccttaccgtggacggctgcctcccttgcgggtcagctcaccggcttcgggtaaaaccaactcccatggtgtgacgggcggtgtgtacaaggcccgggaacgtattcaccgcggcatgctgttccgcgattactagcgattccgacttcatgcactcgagttgcagagtacaatccgaactgagacgactttttgagattagcttcacctcgcgatgtcgctgcccactgtagtcgccattgtagcacgtgtgtagcccagcccataagggccatgaggacttgacgtcatccccaccttcctccggcttatcaccggcagtttccctagagtgcccagccgaactgatggcaactaaggatgagggttgcgctcgttgcgggacttaacccaacatctcacgacacgagctgacgacagccatgcagcacctgtgtgacgtccggccgaaccgaaaaccccgtctccagggtcgcgacgtccatgtcaagggctggtaaggttctgcgcgttgcttcgaattaaaccacatgctccaccgcttgtgcgggcccccgtcaattcctttgagttttaaccttgcggccgtactccccaggcggagtgcttaacgcgttagctacgacactgcgatactaagtatcccaacgtccagcactcatcgtttacggcgtggactaccagggtatctaatcctgtttgctccccacgctttcgtgcctcagcgtcagtttcgggccaggcagccgccttcgccaccggtgttcttcccaatatctacgaatttcacctctacactgggaattccactaccctctcccgaactccagcctaccagtctcaaaagcagttccggagttgagccccgggctttcacttctgacttgataagccgcctacgcacgctttacgcccagtaaatccgaacaacgctagcccccttcgtattaccgcggctgctggcacgaagttagccggggcttcttctacgggtaccgtcattatcttccccgtcgaaagagctttacaatccgaagaccttcatcactcacgcggcattgctggatcaggctttcgcccattgtccaatattccccactgctgcctcccgtaggagtctgggccgtgtctcagtcccagtgtggctgatcatcctctcagaccagctaccgatcgtcgccttggtaggccgttaccccaccaactagctaatcggacgcgggctcatccatctacggccgaagcctttcccccgaagggcgtatgcggtattagctgcagtttcccgcagttattccccatagatgggcagattcccacgtgttactcacccgtgcgccacgtaagccggaaccgaagtcccgaccccgttcgacttgcatgtgttaggcatgccgccagcgttcgttctgagccaggatcaaactctcaagttgaaccttcgctgcatgatcgctcacacaacaaggcttcaaccgaaaatcgtcccggcatctctctaggcacaaggtcatatcgagatgccaaggcgctcatcggtcagtcgttcttaaagtcctaagatcgacgaccgccgccctcgcatcccttccgatccgtttcacaatgtcaaagatcctgacgaagcgttcccgccccgcggcaccctcgggcgcctgcccctcttaagggcctgcctcgtttaagaggctgtattctctggcttttcagccccgcccggcgccgcgtcctccgcggtgcccgtcggtgtggggcggtttttacccctgccgtccggctgcgtcaactgcttttttcgaagcgttttcggtggctgtttcggcgtgtcgttcagcgcatttctgcgtggcgacaatttctgaggttacagaagccggcagggtctggcaagcagtttttgcggcatcatgccttctgctccccgccccttggggtgtgaggcggatatggtgcgcatcttcgccgtcgtcgagtcccccgccgtcgaaatcggcagcgttcatcggcctgcgatattccgccgcggcccggaccggacacctttcgctaaccttcatttaagctttggccgctagcctgaggagcaacgacaagggcccgcgccccgcgcaccatgcgcgacgcgtggcgataattacggttcccagggtcgccctgatccacgccccattcagcagaaggcagccgacggatggcccgacccaccaaccgcgcgatcaccggaaagaccctcaggctggcagccctcgttctggccactgccctgttcagccccgcggttctgccgggcacgctccccttgcccggtactgcccgggcggcagaaggatccactctggccgcgcctacgggcaaggtcattctcgaggtctccggcagcatcgccgtgaccaacacctccgaaggctccgccgccttcgatcgcgccatgcttgccgccatgccgcgctcggccatcgagaccaccaccccctggacggaaggcgcacaacgcttcgaaggggtattgctggccgatctggtggcgcgcctgggagccaccggcaccaggatcaccgcccgggcactgaacgactattcctatgccttcgacctggccgatgcgacgtcgcacggtgccctcatcgccgacctcaccaacggcaagcagatgtcggtgcgtgagcgcggcccgctctggatcgtctttcccctcgacgagatgaaggaaatgaccgaggtcgagcggcacgagatgcaatcgcgcatggtctggcagctcaagcagatcacgttcaactgactcgacctccagtctccccaaccggatcggccgccggcatgcgacgccttctcacttcgaaacgccttgcagccgcgctcggtgcggtgatcgtgatcctggtcacgaccattggctggaccgtggctcaactggtgtccgaaacccgactgagggcgaccgagcgaagcgagcgcgactgggccgtggtgcagctggaatttgaaaccctgcgcatggccgacgcctacacccattaccgattcgagcgcaaccaggacgcgctcgacgagttgttgctgcgcgccgacatcgtcgagagccgtctcagcctgttccgcgagggcatcgtcgccgatgcgctggccgggcgcccggacatcaaggatctggtcttcaccatccgcatcacccttctggatgtgggcatggtggaaacctcggacgatgccgaagccatcgcagcactcgggcgcagcattgaagcgttacgggcaaaggcctacgacgcctcggtggcgcttctgctcgacagcaatcgcagccttgccgcactcgaggtgcgcctcagatcgctctggtactggatcgccctgccgctcactgccctgatccttgtcggtggcttcctggtcgtgctgctgaccggggcagtgaggcgggaaagccagcgccgcgaagaggcgacccgcgcccgccgcgaggctctggccgccgaacagatgctgtcgaatgcgatgagcgcgatgtccgacggcctgctgatcgccaaggccgacggccggatcgtcaccgccaatcgcagggtcgacgagttgatgcctgcaaccatccgccggcccttcgcgggccggcagatccagctgctgcgcgaccagttgctcgccgaggcggtcgtggacatccgcaccagcgcggcggacacgggcgcggaaatcgatccgctggatccgcagcacctggaccgcgatcacgagctgcatctggccggcgatcagtggctgtggatcagccgccgcaccacagccgatggcggcatggtcttcgtgatgtcggacatcacgtcgctgaagcggcgcgagcgcgaccttgcaaccgccatgcatgcagccgaggcggccagccgggccaagaccgaatttctggccaatatgagccatgaattcaagacgccgctcaacgcggtcatcggcttcaccgatatggtcatgcagggggcggccggcccgctgaacgagcggcagcgcgaatatctgggccatgtccgcgacggcggcaaccgtctgctgtcgctgatcgacgacatcctggaaatggtgcgcgccgatcgcgacgggctgaaggcggcaccgctggacctggaccggctggtcgcagctgcggtcaccgacgccgaacgcgccgcccgcgaggccgatgtcacactggcccggctggagctggatctgccggtacatggcgcgatccgcggcgaccggcgcctgctgcgccgtgcgatcgatgcactgctgtcgaatgcgataaagttcacgccggcaggcggccatatcaccgtcagcctgcgcaacaccaccctgccccatccggaaggcagcccgatcgccggggtcgaggtgagcatcgcggatacaggtatcggcatcgctcccgaacagatcgaacgggtgcagcagcccttcgtgcagatcgacagcagcctggcccgccgttacgaaggcgccgggctgggcctgccgctcgcccggcgattcgtcgaggcccatgacgggcagttgagcctgaactccgcccccggcctcggcacggaagcccggatctggctgccgctcgccagtgccgaacccgaggcggcatcggcaacgcggctgcggatcgccgcgcgctgagcgcgcccccgctcagctctcttcccgcccgctctctgcgggcaacggcagcaggatcaccgcctgcgtcccctgccccggctcgctgaacaggttcagccgcccgccatgggcctcgaccagccggcgggccagcggcagccccagccccgtcccttcgaagcggcgcgagaagccggcatcgagctgaacgaagggctcgaaagcccgctcgatctcgccggggggcatgccgatgccatcatccgcgatctcgatccgtatcccgccgcctccctcttgaccgctcccctcgtgcccagccccttccggcccagccccttcctgcccgacatccaccatccgccgcgcggtgatcgtcacccagccgcccggctcggtgaacttgatcgcattggagagcaggttgacgatcacctgccggatgcggacctcgtcaaccacggcaggcaaggccggcgggtcaacatcgagcgacagcgtcaacccgccctgatctgccttgggctgcagcatgcgcacggtggagcgcagcagccgggcgagatccagcggccggggatcgagcggcagggccgccgcctcggcgcggctcagatccaggatgtcgttgatgacgctcagcagatgggtggcgctgtcgcggatatcgcccatgtattcgcgctgccggtccgacaccgggcctgcatagcccatcagcagcatgtcggtgaagccgatcacggcgttcagcggcgtgcgaagctcgtggctgacattggccaggaaatcggtcttgaccttgttagcccgttcggccgcatcacgggcggcagcaagcgccgcttcacgcgccttgatcgcggttacgtcggaatagagcgacagcagcccgccgtcatgcgtcgggctttcgcgcaccatcagccagcggccgtccgccatgcgtatctcgaaccggccacgcccgcgggcgcgcatctcgcgccggcgccggccccaggcctcggccgtctcccccatggtatcgatgatgccgcgctccagaacgtcacggatcagggcctcgaaggccatgcctggcgcgagttgcggggcacctgcgcccagcatctcctgatagcggatgttgctgatgatatagcggtcatccggcccgcagagcagcagggcgtcggtcatggaattcagggcgtcgagcaggcgcgcctcgcttgtccgacgcacccgttccgccgcctcggcccgagccagatggcgccgggcgatggaccgctcccgccggaccagcatggccagaaccacgatcatggcgccgaggccgagcagcatggcggctacagcagccgggccgggcgtgatcatgccactgcccacggcaagcgccacggcagccgcggcgatcccgagcgcgatcagcccgcgggtgaggcctccgccggattccttgtcccactgctccacgggcgatccctcattctgctgcggcggtcctgcttgttgtcattcgtgaccgtccgccctcaactccacccgctcgaagccgcggggtcaagcaccgagcgtggccgcatcatcagcgcttgcaacgcgccgccacaggcagtacaaaccgcgtcgaccgcatacgggatcccggggccgtagctcagctgggagagcacctgctttgcaagcagggggtcaggggttcgatccccctcggctccaccaattccgtcgcgtcagaatgtctcagcaggggccgaccgcacacgcggccggcctttttcgtgtctgcccccgccgtccctgccccacgccgtccccgaacggagcccgaccacgccatgcccgtgcccagccccacccacgtcctgaccatcacctgccccgacatcgtgggccttgtggcggccgtgtccggcttcctgtccggggaaggcgtgttcatcaacgagagcgcccagtacggcgacccggaaacccagaccttcttcatgcgggtggtgctgtcggtcccgggcgatggcgatggtgcgctgggggtgcgcttcgccgaggttgcgcgccggttcgccatgcgctggacgctgcacgatctgcgccgccggccgcgggtgctgatctgcgtgaccaaggcgggccactgcctgaacgacctgctgcaccgctggcacagcggcctgctcccgatcgaggtggcaggcgtgatgggcaatcacgacagcctgcgccatctggccgactggcacaacgtgcccttccaccacctgccggtgaccgccgcgaccaaggcggaccaggaacgcgccctgctcgacctgatccgcacgctggatgtcgagctggtggtgctggcccgctacatgcagatcctgagtccgacgctctgccaggcgctgtccggccgctgcatcaatatccatcacagcttcctgccgggcttcaagggagcccggccctatcatcaggcccatgcccgcggcgtgaagctgatcggcgccaccgcccactacgtgacgacggatctggacgagggcccgatcatcgaacaggcggtggaacgggtggatcacacccacacggccgaagaactggtgaccatcggccgcgacatcgagacggttgtcctggcgcgcgccgtacagtggcacgtggagcgccgggtgctgatcaatcaccacaagacggtggtcttccgctgaacaaacgccccgcggtaccgcaggctgtgtgacgcatgcagcttttgcttgccgcgggtcacccccacccggctaaactggcagaaccaacggccggtcccgcagaggtcgggacgctccgcctggggaggcggagggccggatgaatgccggaaacagcggcaatacgggggtaacgacatccatgatttctctgggcaagcgcgccggcgcacgaaagctggcggggctggcaatggccgccgcgatcaccattgcggcaccggtggcggccaaggccgaacagttcgtcaacgtgctcaccggcggtaccagcggcgtgtactacccgctgggcgtggcactctccaagatctacgccgacaacatcccggacgcccgcacctcggtgcagtcgaccaaggcgtcggtcgagaacctgaacctgcttcaggccggccgcggcgagatcggtttcgcgctgggtgattcggtgggcctcgcctgggcgggcgacaccgaagccggtttcaagggcaagctcgacaagctgcgcgccatcgccgccatctatcccaactatgttcagatcgtggccagccaggacagcggcatcaagacgctcgccgatctgaagggcaagcgcatctcggtcggcgcgccgcgctcgggcaccgagctgaatgcccgcgccattctgggggcggccggtctcagctatgacgatctgggcaaggtggaatacctgcccttcggcgaatcggtcgagctgatgaagaaccgtcagatcgacgccaccctgcagtcggccggcctgggcgtcgcctcgatccgcgacctcgccaccagcgtgccgatcaccatcgtggccgtgcccgcggatgtggtggagaagatcggcgatgccgcctatcaggcgaccgaaatcccggccggcacctatgacggccagaccgaggcggtgccggcggtggccatccgcaacatcctggtgacccatgccgaggtgccggatgcgctggcccacgagatggcgaagcagatgttcacccatctcgacaccatggtcgcggcccatgccgccgccaaggcgatctcactggatggcgcgaccaagggtctgcccatcccgctgcacccgggtgccgaggcctattatcgcgaggccggcgtcctgaagtgacggaacccgaggcggccggccggcgattcatgcatgccaaggcatgcagttcccggccggcttcccgtgtcgacacgcctgtctcgggacatccacgcacatgaccgcatcgaccgtccggcccgccgacgaggcccggcatcagggccatgaccacctccaggatcacagcttcgaggcggggccgatgcatgcgcccctgcccgaccggacccagggcctcggccgggccattttcctggtcgccgtaatcttctcggccttccagatctacaccgccgcctatacgccgctgtcgagcctggtggtccgctcgatccatgtcggcttcctgctgcttctgggcttcatgatcaccgccgcgcaccggccgaaagggtcggcgctgcgctggatcgatctcggcctcggcatcgtcggcttcgcgctcggcctctatcactggatcttcgaaaccgacatcctgctgcgcgccggcgatccgtcgatgaccgacatcgtgctcggctgcgcaatggtcctgctggtcttcgaagccgcccgccgggcgatgggcatcgcgctgccgatcatctgcgcgctgttcctgtcctatgcgatcttcgggcatctgctgccctcgccgctcaatcatcgcggctacggtttcgatcaggtggtcgaccagatgttcctcggcaccgaaggcatcttcggcatcccgatcctagtctcgtcgacctatattttcctgttcatcctgttcggcgccttcctggaacgcgccggcatgatcatgctgttctcggacgtcgccatgggcaccgtcggcggcgcccgcggcggcccggccaaagtggcggtggtctcgtccgcgctgatgggcacgatcaacggctcgggcgtcgccaatgtggtgaccaccggccagttcaccatcccgctgatgaagcggttcggctatcgccccgcctttgccggtgcggtcgaagcgacgtcgagcatgggcggccagatcatgccgccggtgatgggcgcggtggccttcatcatggccgagacgctgaacgtcccctatatcgacgtggtcgaagcggcgctgatcccggccctgctctatttcaccaccgtgctctggatggtgcatctggaagccggccgcctgaacctttccggcctgccgcgcgcggaactgccggatccactggcggcagtgaaggcgcgctggcacctgatcatcccgctggccatcctggtctacctgctcttcgccggctacactccgctgtttgcgggcacggtggggctggcgctgaccgcggtgctgatcctgggcgcgccgatctcgggcctgctgccggccatgccgctccgcatcctgttctgggtggcgatcggccttgccaccgccggcttcttccactggggcatcgacgtcatcgcggtggtgatcctggcgctggtggtggtctgcctggcgatcaaggggctccgctccacggtcgacatgatggtccaggccctggccgacggcgcccgcaatgccctgggcgtcggcatcgcctgcgcgctggtcggcacgatcatcggcgtgatgaccctgaccggcctcgccaccaacttcgcccgggtgatcatcgaagtcggcgatcagagcctgttcctgtcgctggtgctgaccatgctcacctgccttgtgctgggcatgggcattccgaccatccccaactacatcatcacctcgtcgctggtcgggccggcactgctggaactgggcgtgccgctgatcgtcagccacatgttcgtgttctatttcggcatcatggccgatttgacgccaccggtggcgctggcggccttcgcggcctcgcccattgccaaggcgagcgggctcaagatcggcgtgaactgtctgcgcatcgccatcgccggtttcgtggttccgttcatggcggtctacaccccggcgctgatgcttcaggatggcggtccgatggcccaggcgatcggctactggccggcggtcggctatatcgtcctcaaggcggtgatctcgatggggctgtggggggccgccagcatcggcttcctggccggaccgcttgcctggtgggaacggctgctcgccgccgtcgccgctttcatgctggttgcggccctgccggtcaccgatgaactgggtctcgccctcgccgccctggtcgtcggccagcatctgctgcgccgccacatggcgcggcgtgctgcatcatgaccaccgcggccaccctcggcctgtgcattgcactggccgcgggcggcccgccgctcacccgtctgccggccgatcccgatgccgcgctcgaccgcttcaccctcgcctggacccattcggtggagcgcatccgctggcgcgaggattggatcatcggccaggacggccgcctgcatgccggcgaggccgcgatagagggcagcggcgccggcatggaaccgcccgatgatgcccggctgatcgacggccactgggtctacaccccgcatctgccgccgcaggaggcgctgacgctcgccaactccaccatgaccgggccgcacgagatctgtatcgccggcagctgccgcagcctgttcgatctggcacccgccgcacgcgaccggccggtgcgcctgttcccatgtccgggcgatgcgctatcatcggtcgacatgacagcaccggaggcgggaaccgcaagatgatggagggtctgcgccagcggatctggacacggctgcgccagacgctgtggttccagccggccctggcctcggcactcgcgggcttctgggtggtgcttgccatcatcggcgggccgctgctgtcaggcatggacgatctgccgattcccgacaaggacaccatcgtcgaactgctgaagatgggcggcggcagcctgctcaccatcgccaccgtcacgctgtcggtgctgatggtggtgctgaacgccgccgccggccaggcctcgcccagggccctgccggggctgatgtccgaccgcatgacccatcgggcgctggccgccttcatcggcggcttcgtctatgcggtgacgggcgtggtggttctgggtctcggccgcgatggcgacggtgcgcggctgttgatcggcgcgggcgggctgctcacgctctgcctcgccctctaccgcatggtgctctggttccaccacatcgccgatcttctgaagctgtcgagcatgatcgaccgcatcttccggaccggcgaccaggcgatcgagacctaccgggccacaccggcctatgggctgcggcttcagccggccgcgatgccggcgctgaacggaccgggtctggtgccgctctatccgcgcctgaccggacatctgcgtctgatcgacgtcgcccgtctggccggcgctgccgaagcgcaccggctgtcggtgatcatctgccacaggcccggcacggccatgcacccgcagaagccgatggcgatgatccgcccccatgacggccgcccgatcgacgaggcccttcgcaatatcctgatcggctgtttcgacataggccgcgaccgcacagaagaacaggaccccctgctctgcctggaactgctgtgcgaaaccgcctgccgggcgctgtcgcccggcatcaacgatccggagacggccatcatctgcctggaccggctggaatccctgctgaccgggctggtcgcccggcccgccgatgccgatgcccccgccgataccgaagggctggggcgcggtgcggcccatgtggtgctgccgccgctgccgctggatctggttctcgaccgggccctgatgcgcatcgcccgttgcggcgccgacgcggtggaggtttcctgtcatctgctgcaggtgctggaggcgatcgtgcgcaatgcgcagaccgaggccgatgccgatgtcgcccgcgccgccgcgatcagggcccatgcccatgcggcggcagcccttgccaccatccatgatcgggatcgggcggatgcggcccttgccgccatcccgtgaccccgacaccggcttccccccgtctcctgaaaggcagtacgaatgagcgccccccacgatcatgatcacggcccaaatcacagctctggcgacgactggcgccataccggcgtgcaggtcatcgccggcgaccagctggacccgaacaccgcccagacgccgggcatgtcgcgcgccaccgccatcaaccatgcccgcaccggtgccaacaagatctgggccggcaccgtcaccatccagcccgacgccaagaccggcgcccatcatcacggcgcgctggaaagcgtgatctatgtcgtccgcggccgcgcccgcatgcgctggggtgaccggctgcagttcaccgccgaggcggggcccggcgacttcatctatgtgccgccctatgtgccccaccaggaaatcaacgccgcggccgacgagccgctggaatgcgtgctcgtccgctcggaccaggagccggtggtggttaatctcgacatcgagccggtggaaaagccggaagcggtgaagtggatcgatcccatccaccgcagctgaaccaccaaagcctgatcagaccgccgaccagccgccatcgaccagatgggcgctgccggtgacgaagccggcctcgtccgacagcaggaagcaggtgagcgccgccacctcttccggcgtgcccagccggccgatcggatgctgccggaccagatgccggcgcgcttcgggctcgacatgggcgatcagcggcgtgtcgatgaagccggggcagaccgcgttcacccgcacgccctgcgccgaatattcgaccgccgccgtcttggtcagcccgatcaccccatgcttggcggcgacataggcggcggagccggcaaaaccgttcaaccccaggatcgaggccatgttgacgatggccccgccgccggccgccagcatcgccgggatctcggcatgcatggcatagaagaccccgttcaggttgacgtcgatcacccggcgccagccggcgatgctgtaggcgccgaccggtccttcggcaccgccgatgccggcattgttgaccgccagatgcaggccgccgaagcgggtcacgacatcggcgaccagacctgccaccgcatcgggatcggccacgtcgaccgcaaaggccgccacctcgacaccggcatcgcgcaactccgccgccagggcttcggccgcatccgccttcaggtcggcaagcgcgatccgggcaccgcctgcaccaagccggcgcgcaatggcggcaccgataccggatccggcacccgtaacgagggcgatacggccgtcgaaggtcatgagcgatctcctgaaggggcggttggtccggaaccggccggcgtgaacggatctttcaccgcagccgtgacaggcttcgcttgttacggtgtctgtgcaggatgatgaccgtggtgaaacaggtcaaccccgacgcggaagaccgacctggcgtccaggcgatgcggctgcgttgcgacatcgcccggctgcggccggtcaccatcagcatcgggatcgccccctgcccgcccggttcgggccgtgacgacatcgctcgcgcggagctgatcgccctggccgatcgggcgctttatgccgccaaggccgccggccgcaaccgggtggtgaccgcaaggcggtagcgggcttgatcgcggaccacggtcgcgggacactgccccgataaacccggacgtcagatgccggaccggatatgtgagggggaggaggccgcccgcggcggatcatggacagctggctcgtgctcgccctgtcgctgggctatctcgccgtcctgttcgccatcgcctggcagggcgatcgcgtggcggcgcgccgcggcggcacggccgcacgtcgcgcgcctctgctctacgccctcagccttgcggtctactgcacctcgtggaccttctatggcgccatcggccgcgcggccaccggcggcttcgatttcctgtcgatctatgtcggcccgatcctgatgatcggtctcggctggccgatcctcgccaagatggtgcgggtggccaaggccgagaacgtcgtgtcgatttccgatttcatctcggcgcgctacggcaaaagccgggtgctggcagcgctggtcaccgcgatcgcggtggtcgtggtgctgccctatttcgccctgcagctcaaggcgatcaccatcagtttcgaggccctggccggaaaccccttcgccggcacggtcatgcccgacctgcccgggcggaccaccctgctggtcaccgtgatcatggccgccttcgccattctcttcggcgtgcgcaccatccatgccaacgagcatcatccggggttgatgagtgcgatttcggccgaatccctggtcaagctggccgccgccctgatcgtcggcgccgcgatcaccgtggtggtggcgggcgggccggtctctctggtcggcaccgcgcttgccgacccggcactcgcccatatgctggaaccgcggcttggtctcagctggtgggcgatgaccctgctgtcgggcttcgccatcctctgcctgccgcgccagtttcatgtcgcggtggtcgagaacacccatgtcggcgacatccgcaccgcggcctggctgttcccggcctatctgatcgcgatcaacctgttcgtggtgccggtcgcgatggcggggctgctgctcttcgccggtgccgatgtcaatgccgacaccttcctggtgaccgtgccgctggcgatgggagagcccggcctcgccctgctcgccttcatcggcgggttgtcggccgccaccggcatgatcgtggtcggcgcggttgcgctcagtaccatggtctgcaacgatctgatcgtgccggcgctgatggcactgcgtcccggctcccgccggctcagggacaaccccacccgcatgctgcttctggcccgccggctggcggtgatcggcatcctggcgctcgcctatatcaactacctgctgctcggcagcaccttcccgctggtcaccttcggcctggtgtcttttgccggcgtcgcacaattcgcgccgcccctgctgctcggcctgttcttccgccaggtcaccaaggccggcgccatcgccggtctggtcgcaggcttcgccgcctgggtcgccaccgtgctgctaccgtccttcgccgaggccggtgtggtcgccggcagcctgctgcacgatcttctgttgcggcccggctggatcagcatcgacgacatcaccagcgtgcatgatctggacgtgctctcgggcggggcgctggccagcctggcgctcaatctcgtggtgctgctggcggtgtcgcggttcacccgccagtcggatctggaggcgcggcaggcggaacgtttcgtctccatgcgccacgagctgggcgaacggcgggtgcacccgcgcggcgcgaccctggccgatctgcacgaactggccgcacgctatgtcggccgcacgcgcgccgatgccgccttcgccgacctcgcccaggcccgcaaccctcataccgacggcttcgacgccgcaccgccgctgcgcatcgaccaggaagcggtgcaggcgaccgaatggctgctggccggcgccatcggctcggcctcggcccgggtggtggtggccagcctgctcgccgaccggcgtctgtcgcgttccgacgcccgcagcatcatcgacgaggcctcgcgcgcgatcctcgaccagcacaccctgctgcgctcgacgatcgaaaatgtcggcaagggcatctgcgccttcgaccgcgacttccggatcctggtctggaaccggcgcttcctcgacatgctcgacgtcccggaaagcctgatcaccgtcggcacgcccttgtccgacattgtcgaccatctccatgcccgtggcgaattcagccatgaccgcgagatcgtcaccctgctgcgccggtacgatcccgatctgcgcggccggcccgacatgtatcagcgcatccgccccgacggcacggtgctggaggttacctccaacccgctgcccgatggcggcttcgtcgccgtgttcaacgatgtaaccgaacgccatcgtgccgccgaagcgctgcgcgaagccaatgaggggctggagcgcggcatcgccgaacgcaccgccgatctcgccgacgccaaggccgaggccgaccgcgccaaccgtgccaagacccgcctgctggcggcggtcagccatgatctgctccagccgctgcacgccgcccggctgttcatctccgccgcccgcgaccgcggcaatgatccgctggtcggtcaggccgatgcagcactccgctcggtcgagcagctgttaggcgacctgctcgacatcacacggctcgataccggcgtggtcaagcccagccgcggcgcggtggtggtcgacgaggtgctgcggccgctgatcggcgaaatggtcgtggtcgccgcccgccacgggctgaaactggttcacgtcccctgctcggtcaccgtcgagaccgatgccgtgctgctgcgccggattttgcagaacctgatcggcaatgcgctgcgctatacccgcagcggccgggttctggtcggctgccggcagctgggcgaccggctgcggatcgaggtccacgacaccggccccggcatcccgcctgaaaaacaggccgagatcttccaggaattccgccagctcgacggcgggccgggggaccgcgacaaggggctggggctgggcctgtcgatcgtcgagcggctggcggcgatcctcggccaccgggtcgggctgcgttccacccccggccgcggcagctgtttctcggtcgagctgccggtgagcgaaagccgcgccctggcgcggcgcgtggcaccagagacccgcggcggcggcttcgacggtacgctggtgctgtgcatcgaaaacgagcccgcgatcgcggaagccatgaccgccctgctcggcggctggtcctgcgaggtgatctggggcacaactgccgaagccgccctctcggcactcggcgatcggcgccccgacatcgtgctgaccgattatcacctggaccacggcctgagcggtctcgacgtgctcgccggcctgcgcacccgctttggcgcagacttgcccgccgccgtcatcaccgccgaccgcagcgatgccgtccggcgtgcggccgaggcggccgactgccgcatcgcctataagccgctgcgcccgggcgcactcagggcgctgatcgcgcatatggtcgcgaagggaagaagccgggccgccgaatgacctcggctacgggtgatgtcagctgcccgccgtctcgacctcggtcgcatgcagcgccagccggccggccagaatggcggcctgggtgcggctcaccacgcccaggcgacgcaggatcaccgtgacatgggccttcaccgtggtttcgaccacgcccatttcataggcgatctgcttgttgagcttgccttcggcaatgccggccagcacgcgcagctgctgaggggtcaggccggcgatgcggtcggcgacgtcgacatcctcggccgtgtcggcttcgtcggtgtccggctgccagatctggccctcgatcaccgcccggatcgcggcacccagccggtcgactggggccgatttcggcacgaagcccgaggcgccgtactgcatcgcgcggcggatggtggccgcatcctccatcgcagagaccacgatcaccgggatggcgggatgttcgttgcgcagcagcataagcccgatcagcccgttcatacccggcatgtgcaggtccagaagcacgcagtccaccgcgtcgtcatgggccagcgccgtctcgaccgtcgagaaatccgaggcttgcatggtctcgctaccgggcaggctgtcggccaccgcctggcagagtgccgcccgcatcagcggatgatcgtcggcgatcaggatccgatacgacatgtcccgccctcccctcgggtcccgggcatccggctgcgttggccgtacccttatgaggcaggatcatgcgcaagtttctgtccgacgcaaggccggtctgcatatgaattgaaacgggcagccgaagctgcccgtttcatgataccccattcgcgggtgcagcacgcacccttgggctgtatgttgcgccgctcaatcgtgctggtagatgtccacagacttcgtgtcccggacgaagagcacgccgatcaccagggtcgccgccgcgatgacgatcgggtaccagaggcccgaatagatgtcgccggtagccgccacgatggcgaagctggtggtgggcaggaagccgccgaaccagccattgccgatgtgataaggcagcgacatcgaggtgtagcggatccgggtcgggaacatctcgaccagcatcgccgcgatcgggccatagaccatggtcacgtagatgaccagcacggtcagcagcacgatcagcatcacatggttgacccgggccggatcggccttggcggggtagccggccgcggtcatggcatcgccaagcgccttgttgaaggcggcgccggcggactgcgggtcgaccggggcggcgtggctgccgccaccatgcaggttgacctcggtcttccccgtggcgcccgatgcatcgtagctgtcgatcaccacatcgccgacgcggacctgggcgatggtgccggcgggggcggcctcgttgctatagggcgcgcccttcttcaccagggccgacttggcgatgtcgcagctgctggtgaatttggacgtgccgaccgggttgaactggaagctgcagctctccggatcggcatagaccacgatcggcgcgctggccacggcctgttccagcgccggattgccgtaatgggtcaggcccttgaagatcgggaaataggtcacaatcgccagcgccaggccgaccatgatgatcggcttgcggccgatgcggtccgacaggctgccgaagatcacgaagaagggggtgcccagcagcagggcggcggcgatcatcaggttggcgtcctggggatcgatcttcagggtctgctgcaggaagaacagggcatagaactggccggtgtaccagaccaccgcctgaccggcgaccaggccgaacagcgccagcaggacgatcttgaggttcttccagttgccgaaagcctcggtcagcggcgccttcgaatgcttgccctcttccttcatcttctggaagaccgggctttcgttcagcatcatccggatccagaccgacacgccgagcagcacgatcgagatcacgaagggaatgcgccagccccagctttcgaaggcctcggccgacatcgacaggcggcagcccaggatgaccagcagcgacaggaacaggcccagcgtcgccgtggtctggatccaggcggtataggcaccgcggcggccgttgggggcatgttccgcgacataggtcgcggccccgccgtattcgccgcccagcgccagaccctgcagcaggcgcaggatgatcaggatcaccggtgctgccatgccgatcgtggcatagttcggcaggatgcccacgatgaaggtcgaggcacccatgatcaggatggtgacgaggaaggtgtatttgcggccgatcaggtcacccaggcggccgaagaccagcgcaccgaagggacgcacggcgaagccggcggcgaaggcgagcagcgcgaagatgtaggccgccgtctcgttcacgcccgaaaagaactgtttggcgatgatcgcggcgagcgagccatagagatagaaatcgtaccactcaaacacggttcccagcgaggaggcgaagataaccttcttctccttgctggtcatgggtgcggccttgcccgtatccgccatggatatgttggccatgtatcctccctgcaacgtggcgttgctcagacgttttctgcgttggaagacgctgcctgacgccgatcctgaagcagggccgttcccgcggacccggatgcttcgatcttccccatcgcccgtcaggccggtcgatgatggaacgatgcgccgcgcggccgaaggacgcagccccgaccttggtcggggtgagatctgatacagggcattgaaatgaaagaagaatttttgtgcgccgcaacatatcgtcgcaccgcagcgcacaagctgcctgcctgagcattcacccggcgattgtgtcacgcccgctcaggcgccggcatcgatccagtcgaccagaagcccggcaagtgtgtcggaattgtcgtccatcatcggcatgtgcgaattgccgcggatgcccatggccggcagatccatcagggttgccgcaactccggccgccctcagctgatccacatggctgcgggtggtggcggccagatccgcccagaacggcgtctcctcgacgaaatcgcccagcatcagcaggcgccgctgcggtcggccatcggggcccaggggcgaccagccctcgggcagggccggcatgcctgacggttcgatgccgatacagccgcggacgaggtcggggcgcgcggtcgcggcggcatgggtgaaccagccgccctggctgtgcccgaccaggatgcaggggccgacggtttcgatcaccgcgatcaacgccgccagcgcctggggcgccgtcgacagccagcgcggcacatggttgcggcagaggtcgtcgaaacctgccagcgggaagcgttgccccggaaaggggcggcgcgccgccatatccgcagcagcgcccagccgatagagcgtccaggcctgttcatcggtgcgcatgatcgcacggccggcccagtgcccctccaccgcacaccacccggcgcggccgcgctccaccccgtcaacgacatgggtggtgaacccggcctgaacgaaacgggtcagccagccgggccggccatcgggtgtcgtctcccacatcgatccggtcagcgcaccgccatgaaccagcaccagcggcagcgcgcccggccgggcgttgcgcggcacgaaactctggacataggcctgatcggcgaagaccgcgccattgggatcatggatgaaatccggggtatcggccgagaaattgatccgctcgggtgctgcatcccgggtgacgacccgcccgccgccgcagcgaaagctgcggaagcaggcgagatccatctcgtggcctcgggcctcggtcacttcgccaccagcgggcaggcgctttccgacagcggccagaccagctggtcgccggggatggtcgccacgatgtcgagatagtcccaggggcctttggattcggccggtgccttcacacgggccagatacatgtcgcgcaccacccggccatcttcgcgcagccgggcattgcggctgtagggatcgtcgatcggcagcgcgcgcatcttcgccgaaaccgcatcggcatcggtgccacccacggcatccaccgccttcagatagtgcagcacctcgccatagacgccggcctgaagcatgccgggcatggcgcccacccgctccatatagcgcttcgacagcgcccgcgcgcggtcgtcgacatcccagtaggacggcgtggtgagataggtgccctgcgccgcctgcagccccagcccgtggatgtccgacagcatcaggatcagggccgccagcttctggccgcccgcgaccagaccgaattccccggcctgtttgatggtgttgatcgtatcgccgccggcattggcgatgcccaccaccttcgcccccgaggcctgggcctgcagcaggtaggacgagaaatcgggcgtggccagcggatgaaacacctcgcccaccacctggccgccggctccggtgacaacggcggctgcatcgcgggcgagctgatggccgaaggcgtaatccgaggcgatcatgaaccagctgtcgccgccggccttcaccaccgctccggccgtgccccgggacagggcataggtgtcgtaggtccagtgcacgccatagggtgagcaggacttgccggtcagcgccggggtgccggcgcccgagaacagcaccatcttcttcttttcgcgggcgatttcctgcaccgccagcgccacggccgaattgggcacgtcgacgatcacgtcgaccccggcctgatcgaaccattcgcgcgcaatcgacgagccgagatcggttttgtgctgatgatcggccgagatcacctcgaccgggcggccggcaaccttgccgcccatgtcttcgaccgccagccgcgccgcctcgaccgagcccttgccggtcgcatcggcggtcacgccgccgagatcggtcagcacgccgatccggatcggcttcatctcatccgccgcggcctgcccggccacggccatcagtcccgccaccacggccaggaccaccgccaggcggccgccggccgccttgctcttgttccgcatctggtttcctcccgctccggcgccatggcgccgcgggcttcagggcgcagaggcccggcccgttcttgtgtgctcggcttgtgtggtcgggcatctcgcgccgggtcgccgatctgctatcgtgcggagcgctgatgccatggggagcataatcctcccatatgggacgaattgtaaacccccgccagaccaggctgccaccaggaggcccgcccttgccccgtccgccgaagacccccgccgacatggaggagacggcccccctcgtccgcgatctgaaactcttcggtctgttcgacacggtgccgatccgccaggcctatcgcctggcgttcctgaccaatttctaccgggcaccgctgctgcgccggatcgagcaggaacacgggctgacccgcccggaatggacgatcctgatctgtctcagccaccaggacgggctgaacccgcgcgacatctgcgatttcaccgaacagccgcgcaacaatgtcagccgcggcgccgccctgctggaggccaagggcctgatcacccgcggccccgacccggaggatgcccgacgcgcgctcctgcacctgacggagaccggccgcgccctctacgcccggctgatgccgttgtttcaggcccgcgaggccgaaatgctggcggtgctgagccccgaggaacgcgcgcagctcgaccatctgctgacccggctgacggcggagctgccggtctggcggtgaccccgcagcccgcatcctccggaaccgatggcgacggcgccggttgctcccccaaaccgcaacctgcaacggagccccccgatgacccggatcacccctgagatgcagcgctgcatcgatgcctgtctcgcctgctaccagtcctgcctgggcacgggcatgggccattgcctggaaagcggcggccgccatgtcgcgcccgaacatttccgcctgatgatggcctgcgcggaaatctgccgcacctcggcgcatttcatgctgaccggcacccgccaccaccgccatgtctgccgcgaatgcgccgagatctgccaggaatgcgcccgcagctgcaacgacctggacggcatggaggcctgcgccgcagcctgccgccattgcgccgagcggtgtctggcgatggcggcgtgaggatcacgtcatctcgccaggtgagataaatatcgttcagagatgaagaaggcccgggcggtttctgctgtccgggctccttcaccgtcaatcagcagcagtgccgaaattttgcatcggacttctgctgattcatctggtcaattttttcgacgtgatctaaatttatatcttcgttaacttgtgataatagaaagtaatcgctttcatattatcaatttaatatatacaatttttgcgagtattcaaagtgatacaagagcacattctgccccctttgaaccattccctgacactgatcaacttcccactaacggcaactacgctcagagcgtataatgtggcgcacgcggtttgagtgggacgacgccaagcacaagaagaacctgcgagatcgtggctttggttttgaccaggccgccaggatcttctccggccacgtcgtcgaatggctcgatgaccgcttcacctatggtgaggaccgcatctgcgccctgggtatggtcgacggccgactttattgcattgtctacaccatgaggggtgacacgatccggatcatctccgcccgcctcgccaccagaagggagcagtcgctatggccataacccgcatgacgctggacgagatcatgtctcgacctgccgaggtggatcaggcgaagatagatgccaccaccgaagccgacctccgccggcatatgatcgaagacggacaggatccggacgcccctctcgacaccctccgtttcctgaacccacgcgacgtccgccgccggttgggcatgacccagaagcagttcgcggacgccctgcatatccctctggggaccctgcgcaactgggaacaggcccggacggcgccagatccggccgggcgtgccctgatgatcatcctgcaacgcgaacccgaagcggccctgcgcgctctccggcagtctgcgtgacctgtactctcgccgaaggttcttgcgggatcgcagatgctcccgagtcagtgaccctgcgccgggcatacggcaacatcacctcgccgcctccgggtccgagatgagaatatcgaaccctcgccggcctgtcggatcaaaaagaaaaaggcctgaccagcagacaagccggtcagacctttttccgatcacaccggaagtgtgatccgattggtagcgagggagggatttgaacccccgaccaagggcttatgagtcccctgctctaccactgagctaccccgccgcaatgcgttggtgccggttcgtcttcggcgccgccgctcaggtgggcgtgaaatagcggatcggcgggcgggttgtcaaggggcggtgtgacggtttttggcaggctggtccccgatcgcggtcgtggcggtcaggccgtagaggcgggccgcggcggccgcgtcgtcgaggatgggcggcaggcggtcgcgcaggccgcgatacgccgcccgggcctcgtggcgggtatggggccagtcgctgccccaaaggatgcggtcggggccaagccgctgcgccagccaggcaacatggccgtccaccgccacccggctgcgatagggcgcgctcgccttgacatgaaccccgtgatccgacggcagggcggccagggcctgaaaccagggctcgacggccgggtccgccgcctcgggcaggcccagatggtcgatcaccagcccgtccaccgccatggcgagcggcgccagaaccggcgccagacggctgctttccagctggatttccagatgcagcccggcatcgcgcatgccccccagaaagcgccgcacctccggatcggccgggtcgggcacggaggcgcccgccaccaggttccagcgcaggccacggatgccggctgccgccagagctttcaaaccagccgcgggtgtgttcgtctcgaccacggccaccccggcgaagcggctgcggtccagccgttccagcgcgtccagcatcatgcggttgtcggtcccgaggaagctgacctgaacgatcaccccgcccttcaggccatgcgccgccagcagatcgagccagtccaccaagggcgccggccggtcgggcagatagcgcacgcggccgacggccgccacctggtcgtagacatgaacatgcgcatcgaaaccgatcatctcgcctccatcatatagttctatatagaactggttgacctgaggggtcaaagggtttaggcaggaaggcagagggagaccagaccgatgctgaaacagtccatgccgtccgatgagcggctgccggcctatctgcgcctgcgtgacgagctggcggcccgcatcgccgccggggaatggggccccgaccgtgcgctgccgtcggaaaacgcgctcgcccgcgatcaccggctgtcggtgggcaccgtgcgcaaggccgtgcagcagctggtcgatgaaggcctgctggagcgccgccagggctcgggaacctatctgcgcaagcccgccttcgacgcgacgctgttccgcttcttccagatgcagggcccgggcgaagatgcccgcagcattccgaaaagccagctgatcacccgggtgcggatgacggcaccggatgcggtcgcggcgattctgagcacagccgataccatccgcatcgaacgcgtccgctcgctctcgggccggccgatcctggccgaggagatctatatccgcgccgatcgtttcgaggggttggaaagcctgcccgcgggcgaactcggccccctgctctaccccgtctattacgaccgcttcggggtcttcgtggcgcgcgcgatcgatgatgtgagcttcggccaggccgacgccaccacggccgccctgctcggcattgccgaaggcgcgcccgtggcctgtatcgagcgcactgccttcaccatcgacggcaccgccgtcgaatggcggatcgcccgcggcgacgccctgaatttccgctaccgcagccggatcggctgacccgccggttcccccgccgcagacgcctgcccgcggatgcgcccgcggtgcaggcccggccggacatatccggaagccgccacagagaagaccaacgtccagggagggacgacaatgaagacgctcgtgaccacggccgtcatggccggcctgctcgccaccacctcgctcgccgtcgctgcctatcccgaacggccgatcgagatgacggtgccggcgcccgccggcggcggcaccgacaccgccgcccgcaagctcgccaccatcctggaagagaagctcggcaccagcatcgccatcctgaacgtggctggcggcggcggcgcggtcggcgccacccagttcctgcgcgccaagcccgacggctatgccctactcgccacctggaacagcccgctgaccacggtgccgcaggtgcagaaggtcgcctatgacgcggccagcttcacgccgatcgcctcgacctcggaaaccgcctatacgctctgcgtcaaggcggatttcccggccgcgaccggcgccgacttcctggcggaactggccgcccatccagacaaatacacctatggcaatgacggcatcggcggcaccatgcagctcgccgccgagcggatcttccaggccaagggcgtgaaggcggtggccatccccttcggcggcgccggtgaaaccctgcagaacttcctgggcggccatgtcgacatctatggcggctcgatctcgccggtcatcccttacgtccagtcgggagaggccaagtgcctgatcgtcacctcggccgccccggtcgcggccctgcccgatgccgccggcctcgcctctctgggtctcggcagtgaagagaccctgctctggcgggcgatcatgggcccgaaggacatggatccggccacggtcgagaccctgaccaaggcgatccaggaggcggtgaacacgcctgaatatgtcgcgtttctggccacccgcggcgagatccccaatgtcgtaacgggtgaggcgctggcggcccggctgcagggcgaatacgacgcccttgcccgtgtggccaaggcgctgggcctgggcaactgagatggagcggcggcaggacgtcgtcctcggcctcgtcctcgccgccctcggcgggttcgcgggcctcgaggcctcaggctatcgcggcgcctcgggccactatcccctggcactcgggatcgtgcttgcagcgcttggtctggccctggccgtccgtgcggcggtccggggcagccggaagccgcgcccgctggccatccacgcccccaggctgatcggcaccagcgccatgggcgccgcctatctggcactcgtgccggtgctcggcttctacaccgcctcggcgctcgcggtcgcgaccatgcccgtggcgctcggcctgcgccggccggtgctggtcgcgcttggcaccatcatcttcaccgcagcggtctggctggtgttctcgatggtgctgaacaagccgctgccgcccgaaatctggttccgccccggctgaggtttccgcacccccatggacatcatcctccagatcctgtcgggcgtgttcgcggccggcccgctgctcgccatgctcggcgcctcgctgctcggtgtgttcatcggggcgctgccggggctgaacccggtcatggccatcgccctgctgctgccgctcacctattccatggacccgctggtggcacttggcatggtcgccggcatctataacggctccatgtatggcggcgcgatcccggcgatcctgctgcgcatccccggcacccctgccgccatcgccaccaccttcgacggcttcccgatggcggagcggggcgaggcggccaaggcgctcaagatcgcctgctggtcctctgccatcggcggcaccgcctcggcgatcgcgctgatgacgctcggcccgctgcttgcccgcggcacgctctatttcggcccggcggaatatttctggatcgccatgttcggcatggcctcggtcggcgtgatggtcgggcgcgacgcgctgaagggcctcatcgcctcggtgctggggctgctgctgggaacggtcgggctcgaccagctttcgggcagctcgcgcttcaccttcgatcagccctggctgctgggcgggctggacctgatcgtgatcctggtcggcctctacgccctgccgccggtgctgcagctggcagaggccgcggatctcaagggcctgccggccagcgcgctccgcctcgcccgcgtccggctcggccgcgccgaggtgctggccctggtgccgacctggatccgctcgtcgctgatcggcatcgcggtcggcattctgcccggcgccggcggcaacatcgccgcctttctgtcctacaacgcggccaagaaccgcgcccgcgaccccgaccgtttcggcaagggcgcgcccgagggcgtggcggcggccgaatgcggcaacaatgccgacaatgccgcctcgatgatcccggcgctcaccctgggcattccgggcaatgtggtggcggccctggtgctgggcgcgctgctgatccacggcctgcagccgggcccgcagctcttccaccaggcgccggatctggtcggcggcttcatggtgcagatgctgatcacctcggtgctgatcctgctggtgggcggcgccgcagccacgcgggtcttcgcccaggtccagcgcctgccgggggtgatgctggtgccgaccatcctggtgctgatggcggtgggcgtctatgtcatcaacggccgggtggtggatctctggctgatgttcggcgcaggccttgccggctatctgctggagaagctggaggtgccgctcgcccccatcgtgctcggcatgatcctgggcccgatggcggaacagggggtgcgccgcgccctgctgatcggacgtggcgaccccctgcacctggtgtcgagcccgctgtcgatgatcatcgccgcggcgaccgtgggcttcattctctggccgctgctgcggcgcctgaagcccacacgccgcagcgaccgttgacgcctcagggcttcagcttctcctgacgcgacagaagatcacgcagggtcgactgctggcggtcgagattgcggatctggtcgcgcaggctgcgacgctcgtcatccttctgcgccttctggagcttgcgctccagctcgttgatccggaagtcgttgttctggatgtcgcgccgggtttccgacaccttcagaccatcacgaagcgcccgctcgaaggcggcaccctgcggctggccgcggcagacatcgctcttccaggaattgccgtccacgccctcttcccagccgcgggccggggtgcaataggtcttgatgccctgatcccagccggcccgccaggcggcggcattcgggcgcacacccgccttggcgcagtcgctggtatagcttgcgatcgtgtcctgatcctcgccggcggcgccgtcggcatagccggtgcgctgccagtcggccacgcggcactcatcctcgctcatgctggcgcaggcagacacgaccagcggggcggccagcagggcaagcaggatcaggcagcgcctgatcagcctggcgggggtgaagaaagtccgggcattcatcatcggtgcagcgtcttccagggcatcgtcccccgaccggggccggtcgcgggcggcagggcccgcagcgcgcttatagcaccgcatccgatgcccggcacctgcccggccgcccgggggcaaaccgctgtcaacctgccgtcaggcggcagcgacctgcctgtcgacagcgccggtgatccagccgccgcccagcacccggtccccctgatagaacacacaggcctggcccggggccaccgcacgctgcgggtcgtcgaataccacccgggccgtcagcccgcccgccgcatcggccgtcaccgtcagccgggccgctgccggctcgacggtcgagcggatccgcgcctggatgcgcagcccctctgccggcggcagatcgccctcgcccagccagtgcacgtcatgcaccgccacctcgtggtggcccagaagatggcccggccccacgatcacccgccggcgcaccgcatccagccgcaccacataaagcggctcagggccgccgcgatcgagcttcagcccgcggcgctggccgatggtgtagcgatagacgccttcatgcgcgcccagcacctcgccggtcaccgcatggacgatctcgcccggggcctcggcggccggggcgagcttgcgcacggtttcggcatagcggccagacggcacgaagcagatgtcctggctgtcgggcttggcggcaaccaccagaccgtattcggcggcaagcgcccgcaccttcggcttttccatgtcgcccagcgggaagcgcagccgggcgagccgttgcttggtgatcgcgaacaggaaatagctctggtcgcgggccgggtcgcggccgcgcagcagggccggcccgccatcggcgcccgtggtcagccgggcgtaatggccggtgaccagcaggtcggcatccaggtcgagggctgtgtcgagcaggtcgcggaacttcacccgctcgttgcagcgcacgcaggggatcggcgtctcgccggccagatagctctctgcgaaatcatcgatcaccgcagtgcggaagcgctgctcgtaattcagcacgtaatgcgggatgccgagcttttccgccactgcccgggcatcgcggatgtcgcggccggcacagcaggcgcccgccttttccaccgccatgccgtgatcataaagctgcagggtgacaccgacgacgtcatagccctcggccttcagcatcgcggccgtcaccgagctgtcgacgccgcccgacatggcgaccaccacccgcgtggcggcggcgggcttgtcgaggccgaggctgttcatctgacgtgtctttccttgagccggtatcggacggcaggaggccgccgcatgccttcagatgtcggtcgcgcgggcggccgcgtccagtcccatttgccagaacgcggcttccaggcggccggcagcggcgaaaagtccggtcagggctggcagccgcgcctcggcgccgcgctcgcgccagacccggtcgatctggtcggcggcggcccgggcgatcgccagatactcgtcacccgaataggcctcgatccagtcgcgatacgcgtcgccttcgggcagtgccaccgccgccgccttcaggcgcagcccgatctcgccataaccgaccacgcagggcgacaacgccaccagcaggtcgagcaggtcgcccttcagcccggcatcgatcacgaagcgggtataggcgatggtcggcagatcctcgggcgtcgccgccatctgcgcttccgtcagcccccagccggcgcaggtccggacatgcagcttcatctcggtatcggtcagcccgcgcagggtctcggccgcggcgcgcatgtcgtccagcgtctcggccttgaaggcggcgagcgcataggcccgtgcgaactggatcaggaacagatagtcctggatcagataatgccggaaggccggccgcggcaggtcgccccggctcagcccgcgcacgaaatcatggccgatataggcctcccagtcggtgcgggtcagatcgcgcagccgggcgatcagcccgtcttcggcgaacaggccatggccggccggcaggtcgtcgagcattccggatctcctctgggcggtgcggcaggaggcagggcccgcagactagctgcgccagccacggctggccagccccggactggacatcccggccatgcgaaaacgccgccggcagaaccggcggcgtcctcaagatatcgaatgccagaacgcgcggtcccgatcagtcgatcagcgcgttgtggacttccgtcggcagcgagacggtcaggccgtccagctcttcggtgatgatgatctggcagccgaggcgcgaggtcttggtcagcccccaggcgaggtcgagcatgtcctcttcctcttccgccgcgtcgggcagacgctcgaaatcctcgggtgccacgatcacatggcaggtggagcaggccagcgaaccctcgcaggcgccctcgatgtcgatactgttgcggtgggcgatctcgaggatcgacaggccgacgggcgcctcgacttcgcggcggttgccgtcacgctcgatgaaggtgatcttgggcatcgcgtttcttctctcgtccctcgtgtccgccgcacggacccggacgggctccacgcccgcggcggcaagctcgctcggcttcgttgaaccgcattccatcgccgagggcaagcccgaaactctccgagcccgcgggcacttgcgcctgcgaccatcgccagactatgccggatcttccggatattcaacctgtagtgaatgatccgttctcaactcaacttgtgctaagcgccgtccggcaggaaggcgatcagacgtggaagctctcgccgcagccgcagcgacccttctcgttcgggttccggaatacgaaaccggcctgaagcttgtcctcttcccaatccatctcggtgccgatcaggaacaggatcgccttgggatcgatcaggatgcggacgcccttctcctcgatcacctcgtcatgcttggcgacgtcatcggccatttccatggtataggcgagccccgaacacccggcggtcttcacgcccacccggatgccgaccacaccctccttgtcggccatcagaccgcgcagcctgtcggcggcggcatcggtaatgcgcagtgccggcatgggcatcggctggacctccttgctgtgacctgcatgcgacggccgcgaacgaaaccgatacgttccggaccgtctgaccttcgcccccgacggattccgggcgacgcggcctttgaactctaacataatcgctcgcccgccggatgaaagagggcaagatccccatctccggcagaggggccatgcctcatcggcattccaggctgcattcagctgcggatcattccgtccgcccgccagcatcaccgcaccaataccggccgacgcggcagttctgccgcgcaacggccggcacgaccgggaccgaagccacatgaccgaccgacgccacccgatccgcaggccacttcgtgcccgtcccgccgccgcggccattcccgtcctggcagccgcgcttctgaccatgctgccggtgccgggcatcggagcggcctttgcccagggcgctccgcagggcatgccggtcgaagcagccaaggcccggctggaaccgttcgccgagaccatcaccgtcgccggcgggctggaggcggtacaggcgatcgacgtcgcctcggaaatcaccggccggctgtcggcgatcgaggtggccgatggtgccagggtgaaggccggccaggtgctgttccgcctggacgacgccatcgcccgcaccgtgctggccgaggcccaggcctcgatcgaggtcaaccgccgcaatgccgaacgcgcccgcgaccttgcccgccgcggcgccggcacggcccgtgccagtgacgaagccgaggctgagctgctgatcacgcaggcccaggtgcaatcggcaaaggtgcagctggaaaagaccgtgatcacggcccccttcgacggcatcgccggtttccgtcaggtcgatctgggcgcctatgtctcgcccggccagaccctgaccacgctggacgacatcgacccgatccgggcggtgttccgcctgcccgaacgtttcgcgggctcggtccatcccgggacggcggtgacggtggaggtggaggccttccccggcgagcgcttccccgcccgggtggcggcaatcgaccccaggctcgacccgggcggccgcagcctggcggtgcgcgccgagatcgacaatgccgacggccggctcaaacccggcatgttcgcgcgcatcaccgcggtgctgaacgaaatcggcgatgcgctgatcattcccgaacaggccatcgtgcccggccgtgacgggcctttcgtctacaagatcgtcgacggcaaggcgacgccgcagccggtcaccatcggtgcgcggcgcgtgggcgaagtgggggtgaccaagggtctcgccgatggcgacctgatcatcaccgcgggtcagatcaagatcggcccgggcatgccggtgatgccgctgccgaccggcgccgatcctttcgccgagcccgcccccggtgccggcgcctccggatcggatgccgccgccccggctgccgctgccccggcgtccggcggctgatcgcggagaggacagagccttatgaaactctccgatatctgcatccagcgaccggtcttcgcgaccgtgctgagcttcgtggtcctgctgctgggcctggtcgcctatgaccggctgtcggtccgcgaatatcccaacatcgacccgccggtcgtgaatgtcgagaccacctatccgggcgccagcgcccagatcatggaaagccagatcacccagatcctggaagacagcctgtcgggcatcgaggggatcgactacatcacctcgatcagccgccagcagcagagccagatcaccctgcgcttcaagctggaccgcgatccgagcgatgcggccgccgatgtccgcgaccgcgtggcgcgcgtccgcggccagctgcccgacgaaatcgacgagccgatcatcgagaaggtcgaggccgacgcccagccgatcatctatctcgccttctcgtccgaccggcattcgccgctggagctgtcggactatgccgaccgctacgtcaaggaccagctccagatcctgaccggcgtgtctcaggtgatgatcttcggtgagcggcgctattcgatgcgcatcgcgctcgacccgatccgcgtcgccggctacggactgacgatccaggagatcgaggcggcgctggccgcccagaatgtcgaaatcccggccggcacgatcgaaagcgccgagcgcgaattcaccgtgctctcggaaaccgatctgcagcgccccgaacagttcaacgccatcgtgctcgccgagcgcgacggccatcagatccacctctccgatgtcggccaggccttcatcggtgccgaggcggaagacagcgccgcccgcttcaacggcaagcccgccgtggcgatgggtgtggtcaaacaggcgaccgccaacccgctcgacgtctcggcggcggtacgcacgcgcatccccgagatcatcgagaacctgcccgagggcatgcgggtcgacgtcgcctatgacagctcggtcttcattcaggaatcgatcaacaatgtctacgacaccatcatcgaggcggtggtgctggtcatcctgatcatcttcctgttcctgcgctcgctgcgcgcgacgctggtgccgctggtgaccattccggtctcgctgatcggcgccttcttcatgatgtatctgctgggcttcaccatcaacacgctgaccctgctgtcgctggtgctcgccatcggcctggtggtcgacgacgcgatcgtgatgctggagaacatcttccgccatatcgaggcgggcatgtcgccgatgcgcgcggccttcaagggcagccgcgagatcgccttcgcagtcatcgcaatgaccatcacgcttgccgctgtctacatgccgatcgccttccagaccggcaccaccggccggctgttcaccgaattcgccctcaccctggccggcgccgtgctgatctcgggcttcgtggcgctgacgctgacgccgatgatgtgcggcgtgctgctgaagcaccagaccagccacggcctgttctaccggatcatcgagggtttcctgaacggcctgacccgcggctatcgggcaacgctcaagggcgcgctcaaggtccggccgctgatcctgctgatcggtctgggcgttgcgagcggcagcttcttcctgctcaaggccctgccggaagagctggccccctacgaggatcagggtttcctgatcggcttcctgatcggccccgagggcgcgacgctcgactataccgagcgctatgcccgcgggctggagggcatctatgccggcatccccgaggccgagacctatttcgtggttgccggcttcccgctgaaatcgcagggcatcagcttcgtgaagctcaagaactgggcggatcgcgaacgcagcgcctccgagattgcagcctcggtgatgccctcgatgttcggtggccttccgggtgtgatggccttcccgatcccgcccgccccgctcggccaggaaatcggcgaaaagccggtgcagttcgtggtccagtcctcgctgccctatgaacagctgggcgcgctggtcgacaagatcgtcgcgcgggcgatgcagaaccccgggctgcagaatgtcgaaaccgacctcaagctcaaccggccgcagctgaccgtctcggtcgaccgggccaaggccgccgatctcggcatcggcgtcgacgtgatcggccggacgctggaaaccgccctcggcgggcgtcaggtcacccgcttcaagctgcatggcgaccagtatgacgtgatcatccgcctggatgatcgctaccgggcgacgccgtcggatctgagcgcgatctatgtccgctcggccaccggcgacatggtccagctctcgaacctggtcaaggtgaccgagaccgtggcgccgcaggggctgaaccacttcaaccagctgcgctcggtcacggtcgatgccaatctggcgccgggctatgcgctgggtgacgccctcaccttcctcgaccaggtcgcgcgggaggaactgggcggtcaggcgaccaccgacctgtcgggccagagccgcgaattccgcgacagcgcctccagcctggtgatgaccttcgtgctggcgctcggcttcatcttcctggtgcttgccgcccagttcgaaagctggcgcgacccgttcatcatcatgctgaccgtgccgctctcgatcaccggcggccttctggcgctgtacctctcgggcggcaccttcaacatctacagccaggtcggcgtggtcaccctgatcggcctgatcaccaagcacggtatcctgatcgtcgaattctcgaaccagatccggcgcgagggcctgtcgcgcagcgatgcggtggtcgaggcggcggtgcagcgcctgcgcccgatcctgatgaccaccggtgcgatggtgctgggcacggtgccgctggcactcgccactggcgccggcgccgaaagccgccaggatatcggctgggtgatcgtcggcggcctgctggtcggcaccttcttcaccctgttcgtgatcccgacggtctatacctatatcagccgccgcgacatgaagccgatcgtcgaggcgccgagcgatgccgaactcgccgccgagggagcccagggccatgttgcccactgacgatccggcccccattggccagcccgacggtggccccggggtcgaccttctggtcatgacccttgatgccaccgatccggaggtcgccgcccgactcgccccgcttctcgacgacgaggagcgggcgcgggccgcgcgctttcatttcgaccgcgaccgccggacctatatcgccgcccatgccctggtccgctcggtgctggcggtgcggaccggtatcgccccggcccggctccgcttcaccgccggtgcccgcggcaagcccgaactggcggccgggcagatgcccgttctggccgacggccggccggcgctgcgcttcaacctgtcgcacacccgcgaggcggtggcggtggcggtcaccaccgatccggcctgcgctgccaccgatctcggcgtcgatgtcgaggccgccgaccggctgggcgattacgatgcccgcattgcccgtagcttcttcgcggaagatgaggcggcagcactcgaagccctgcccacggcggcagaccgtgcccgccgcttcctcaccctctggacgctcaaggaagcggtgatcaagaccacaggccaggggctgtcgcagaaactctcgggcttcagcatccgctttcccgccggctggccggccgaggggctgctgcccgatatcgaagcccgcgatcccgccccgcccatgggcctcacctggcatctgagccatcgggaactgccgcctgcagacgggcgcgggggcctgcatctggcgggcgccctgctcgcgcccgtcaggcagccccggccccgctggcggctgcaccgggtgacagcggcgatgctgccccggcttcatctgcaagccgccggctgaaagcgcgcaggatcatgctgcgggcgatctcttcgggatcggtcaccacctccaaatggccctgtgccgccagataggcggcctgatcgtcatcctcggcccgggcgaccacgatcagcccgggattggccgccagcgcctggccgaccacctggccggcctcgaaactgcgcgagatcatcacgaacatcatccgcgcccccgccagattggcggccttcagaatgtcgggcgccgcggcattgccctggacgcattcgatgccgcgcttcgccagatcggcggtgcggccgggcagatcctcgatcaccagaaacggcagatcgcgcgcttcgagttcggcacagatccgccggccgacctggccatagcccaccaccaccgcatgatcggccagcgtcgtcggcaccggcggcaggtcgggcgcatcttcgggccgggccggcggcagcatcggttcggtccgcgcgcgccagatgtcgatcgcccggaagagcagcgggttgatcaggatcgacaggatggcccccgccagaatgaaatcctgcccctcggccggcatcagcccctgggacacgcccagcgccgccaggatgaacgagaactcgccgatctgggcaaggctggccgaaatggtcagcgccgtaccccggccatggccgaaggcccgcacgatgccataggcggccagcgacttgcccaggacgatgatgaccagcgtcgccgccaccggcagggggtcctcgatcaggatcgccggatcgaacagcatgccgaccgagacgaagaacagcaccgcgaaggcatcgcgcagcggcagcgattcctccgccgcccgatgggacagggtcgattcgctcagcaccagcccggcaaagaaggcgccgagggcaaaggaggccccgaaaatctccgaggcggcgaaggcgacccccagggccagggccaggacgcacagccggaacagctcgcgtgagcccatatgcgccacctggtgcagcacccagggcacaacgcgccggccgatcagcagcatcacggccacgaagaccaccaccttacccagcgtgatcgccaccgtggccgcgatctccgggagcgacggcgcgccgcggccctcggcggtcatcagggcaccgaaggccggcaccagcaccagggccagcaccatcgccagatcctcgacgatcagccagcccacggcgatccggccgcgttcggtctcgatcagccggcgctcctgaagcgcccgcagcagcaccacggtgcttgccaccgacaatgcgaggccgaagaccagaccggccgtgatcgtccagccgagcgtcagcgccatccccagcccgagcagcgtcgccagccccatctgggcaacggcaccgggcagagagatccgccgcaccgacatcagatccttgaccgagaagtgcagccccaccccgaacatcagcaggatcaccccaagttcggccagttgcggcaccagcttctgatcggcgacatagcccggcgtcgccggcccgatcgccacgccggccagcagatagccgaccagcggcgaaatcttcagccgctgggcgatcgcccccagcacgaaggcgaggcccagaccggcgacgatggtggtgacgaggggcaggtcgtgatgcatgcgcggccgggtctccggaaaagctgagcggaagaatgaggggcaggcgaaatcgggccgtgaaacaccagacgcagacatgcgtcatcggccacgaaggttgaaggaagggatcagggtgacggggagccgcggatgaaagccgctcatcccggtatatggcgcagcccttgacggttcaagaacctcacccgatttttgcggagagtctgccccgtccacgaaggccgcccccgtatgccccagcccctcccgcatggcccgcacgctgccggccggcagcgcctgctgccgatgctgctggcgctgctcgccctgttgtggacggcgggcgcggtggcgggtgcggtgccgcagctgccggccccgcgggatgccgccggccagcccggcacgatcggtaccgccacggggtccggcacacccttcatcctgccgcgcgatgccgggccggtgcttctggccgatcacggccgccagcccatgggcttgcccgccgcgggcggatcggcccttcccccaccggccgtccccatccccggccaccgcctcgccccccggcgccggcaccttgtggcagaaccgcaggatcggatacggccccgccgcttcacccgccccgccgtccgcgccccgcctgcgggccggggccgcatcgctgccgtctgaccggccgccgcggcccgcatatcaccgacatctccacatcatcgagacatcccgtccctccggatctggcggatgccggcgccactgcgcgcggccgccccggtgcggccgtgcgggcccctatggagaccggttgaatgcgcacatcgcgctggctgatcctgacctatgccctgatcattctggcggggctgtccgcagccctgcccaacctgcttaaccccgaccagagggcagcactgcccggctggctgccgtcgaaagccgtcaccctcggcctcgatctccgcggcgggtcgcagctggtgctggaggtcgacgcctccgccctgctcaacgatcccaggctgaccgaggcggagcgcgccgaacggctgaatgccgccctgacccagagcctcgaaatcgtccgcacgcgcatcgaccagatcggcgtcgccgaaccctcggtccaacgggtcggcgacgaccggatcatggtccaactgcccggcgtgcaggatccggcccggatccgcaccctgctcggcagcacggcgaaactcggcttccatatgctggccgatccgccggccgccggaacccgcccggcacccggcgcgctgttgctgcccatgcaggacgaacgcgacggcagcggcgcaccgcgaaagctggcggttcaggcgcagcccgcgctcgacggtgaccggctggccgatgcccatgccggcttcgatccacgcagtggcgagccggtggtcaatttccgcttcgacgaggccggcgcccggcgcttcgccgagatcacgacgcagaatgtcggccgccccttcgccatcgtgctcgacggccggatcctgagcgccccggtgatccgcgagccgatcaccggcggcgcgggccagatcagcggccggttctcggtggccgaggcgggcgtgctctcggccctgctccgcgccggcgccctgcccgccccgctcaaggtgatcgaggaacgcagcgtcggccccgatctgggcggagacgcgatccgtgccggcatcattgccggcctggccggcttcgcgctggtctgcggcttcatggtggtgctctatcgtggttgggggatgatcgcgaacctggccctgctgctcaacgtcgccctgaccctgggtgcgctctcggcactcggcgccaccctcaccctgccgggaattgccggcatcatcctgggcctcgggcttgcggtcgacgccaatgtgctgatcaacgagcgcatccgcgaggaaacccgccgcggccgcaatgcccgggccgccctcgatgccgggttcaaacgggcctatgcgaccatcgtcgattccaacgtcaccagcctgatcgccaccctgctgctgttccagttcggcagcggcccggtgcgcggtttcgccgtcaccatggcgctcggcatcctcatctcgatgttcaccgcggtcaccgtggtcaggatcgtcatgacctgggtcctggaccggcgcggcgcgctccgctcatccacggccaggctggaaatcgaaccgctgatccggctgatgccgaaaggcgacacccggatccgcttcatgcgcgcccgctttgctggcatcgcggtctcggccgtgctgtcgctcgcctcgatcgggctgttcctctcgcccgggctcaattacggggtagacttcaagggcggcatccagatcgaggccgcgacccatgccgatccgggccgcctgcgcgagcggctggacgggctggggttgggagagattaccctccagcagaccggcagcgacggcgtcctggtccgggtggcgcgtcagcccggcgatgatgccgctcagaccacagcagtcgaaacgctcaaaacggcgatccgggatgtcgaccccgccgccggcatcgagcgggtcgatgtggtgggggccaaagtcagcggcgagcttgccaccgccggcgtgctggcggtggtgctcgccggcctcgccatgatggtctacatctggtggcgcttcgaatggccctttgcggtgggggccatcgcgacgctggtgctcgacatcaccaaaacgatcggcttcttcgcccttaccggcatcgatttcaacctcaccgccatcgccgccctgctgaccctgatcggctattcggtcaacgacaaggtcgtggtctacgaccggatgcgcgagaacctgcgcctgcaccgcacgctgtcgctgcgcgagatgatcgatctttcgatcaatcagacgctgacccgcagcctttacacctcggcgaccgcctttctcgccatgctgccgctggcgatctggggcggcagcgcggtggagagttttgccgtgccgatggtgttcggcatcgtggtcgcggcatcgtcctcggtgttcatcgcagctcccatcctgctgttcctgggcgaaccgatgcgccggcgcagccggtcggccctgaccgcggaggaggcagcgaccgcaaccaccggatgacaggtcatccctcctgaggtatagcggtcgcatccggcccggatgcggccgcccatgccgacgacaccgaaggaggggtttcatgcagcccaccgcctcgcgctgggtccagcccggccaggatcgatggctcaccggtcccgccggccgaagcgccgcgccctggcggctgctctgcatcccccatgccggcggcggcgccagcgccttccgcccctgggaggcgttcaccggcccggatgtcgagcttctggtcgcccagctgccgggccgcgaaagccgttttcccgaaccggcgctcgaccgggtggcaccggtggtcgacgggctggccaccgccctcggccgtcttgcgcccaaaccgaccctgatcttcggccacagcatgggtgcgatgatcggctatgaactggccgcccggctggtgggtgaggcctcgccccatgcaccgcgcacgctgatcgtctcgggccgcaccgcccccggctcatccagcaccttgggcgatctgctcgggctggacgatgccggcttcgcagatgcacttgccgcccgctatgacggtatccccgccgccctgctcgccgatcgcgaattgatggccgtgttcctgccgaccctcagggccgatttccggatggtcgcggaatatcgcccggatcctgccgcctgcccgcgcctgccctgcccgatcctggcgctgggtggcgccgacgacattcatgccgcccccgaacggctgaccgcctggcaggatttcaccaccgccggcttcatgcgcgagatctttccgggcgggcatttctacctggcggccgatcctgcctgggtggttgcgcgcgtgctggccgcgcgcagcatggtctgaggctcagccccccgcgcccgcgaccctggcgccgcccacgggcggggcggtttcaggaacgacgccatagggcccgaaccccgccggcccatagggcgtggtcacggcacccgtgccgccaccgatgcccagccagcggctcagctgttccagggtcaccggctcacccggcaggaagccctggcgcacggcggtgggcgccggctggggcgaggcaggctgcaccggggtcgccggcgccgtctgatgctcgggcgtggtggtttccggcaccatggcccggccgaccgaggcggtgccggcgggcacgccttcgacgaccgcctcgctctcgccgctatccatgcgcggccctgatttcgggccgccagccggcgcgggagccgcacctgtctgattgagcggttccgaaccgaccggccggatctcagccgtgcccgtatccacgtcgcccacgatgaccggctggccggcaccgccatcggcagcctggggcgcgcccgtggcgccggacgtcgtcgccgcgcgggcgccattgctgtcgatgccgcccaggatcagcggcatgccacccgaatccttgttgccgatcaccaccaccttggcattggtcgactgggcgagctgcaccgaggcattgatgccgagccaggtgagataatccggaatttccgaggcgccgacccgatcgaacagcatgcggataccttcgccttcgatccgcttgcgttcggcttccttctgctcggtcgccaggcggtaatcatattccagctgacgctgatactgctcgaccttgcgctcgatcgcctgggcaacccgctcgggcagatggatcgccttgatcagcacgtcctgcagttcgatcagatcgattccgggttggctgtaatagttgccgcgcaggaaattcgacttcacgccttcatagatctcgttctgcacgatggtgcgcaggttcgaataaaaatcctcggccgtgtactgcgagatgcgcgcccgggccaccgatccgacttccgggataatgatcttgtgcagatattccgggccgacattcttgtgcaggatgccgacatattcctggttcacccggtagcggaacgaaatggtggtcgcgaccgtcagaccgtctgcggtgatcgcatcataggtctgggtcacggtctggaagcggacgtcatagatctccagccggtcccagggccagatcacctgcagcccttcccccgtggggttctcgacatcggtcccgctgaaacggtgccagaccaccccggcatgaccggccggcacggtgatgaacatcgccggccagaacaggatgacgagcgcaccaaagatcagcacggagagcgtcagcgaccagagatggcggcggagccagccgccgatccggccgaacagcccgggacgctccggctcgtcggtcatgtccatatcggcgaccgtcatgccgggtcctccccatcttcgtcttcaatacgagcgtcgtcttcaatacgggcatctcggttgtcgacgatcctgaccacgcgcccctcctccatcgccacccgacggtcggcaacgtcgaaatagcggtcgtcatgggtgatggcgatcaccgtcttgccgcgcgctttcagcatcggcagcagttcccggtagaacttgcgccggaactgcgggtcctgatccgccgcccattcgtcgagcaccagcaccggccggtcctcgatcatcgacaccatcagggccagacgcttgcgctggccgctcgacaggtcgatcgtatcgaacaggtcaccctgaagcgctaccttgccgcccatctccatcagcttcaccagcgcgtcaaactcggccacatccggcggttcgatgccatagagcctgcggaagagatggtagtcggcgtagatcgccgaaaacagcgaacgataggtttcgaaagagccgcgggtaaccggttttccatccagccggatcatgcccctgtcggcatgatagaggccgagcagcaggcggatcagggtcgacttgcccgagccgttgccgccggtcacgaagatcagctcgcccgaccggatggtcaggtccaccggccccaccccgaaggacacgccgccgaccggggcataggcaaaggcgaccccgtccagccggatctcctcgaacgaggtcagggtctggggcggggtggcggccacctcggatgcggcgacgatctcgcgcagcacccggtccatgcgcatcagattgtccgcggcggcattggccatcgccatcataggcacggcctgaatcaccatgctgagcgggcccacgatgaacaggatcgccgtcgccgtgcgcaccaccgcctcgggctcggtattgccgaagctcggcaccacgaacaccaccaggcccagcagcaggaagatcatcgtctggccgaagacgaattcattgcccgacttcacctgcatatcggccttggcatcacgggcctcgatcgacacccgcgccatgtcgcgcagcagggcatcgcggcgtgccgacgacagcttcacctccttgaagccgtcgagcacgtcgcgcatgctttcgaaaacctggttttccttcatcatcgcagccggataccggttgcgcaggtcgatcagccgccggatgaccagaaacaccgcaatcgcgatgaagccggtgctcagccagaaggcggtgcggtcggtgatgaagatgtagatcatcgccagcccgaccagaatcaccgactgtgcggcgatcaccagcaggttggcggcctgggatatcgtctgggtatcgcggatgacgctggcgaggatgttgccccgccccacctgttccagcggcagaagatcggatcgcgaaaccgcatcgatcaggctgctgcgctgacgatggatgatctcctccacctcggtggcggtgatctgcatcatccggcgctggctcagcacatagatcgccaccacgatcacaaacagcgccacggtccgcaggtcgagcgcgtcttcgtagagcccggcggaattgttgatgatcgccatcaccagcgcattgctgacaccggcgagcgcggcgatgaacaggagggtcgccggcttcgccgtcaggtcgcggcgaataagctcgatcaagggcatcgtcaccgggcggaactcggtcttgggcgggaaagtcgtgcccgggcctcagacccgggaagaggagcgcggcgtgcccggccgggtccgcgacgcagcaccttgcggctcaatggcgtttcgtcttgcgcgccaccacggggcgtgccggctcgcgcgggcgtgtcgcatagagcagcagcagcatcacgaagggggtgaccagcagcgacagcaggaacgagacgacgaaccccggtttgcggccggcgccgcacagcccgaccatcaccgacatcacgacatagatggtggggagcagcaggcccatggtcggcggcatcgggatggtcctctcggtgcactggtcgtcggacgacctggtgggtcgtcatgcggcaggcgccgcccgccccgccccgcagatgcggtgacggaggcagacggcgatcgtggtcgacggcaatcacgacgccttggtggcggcgggcttggcctcggtcttggtgtcggcagcggccttggcagcctcgacggtggacggcgcatcggccttggcggcctcgaattcggccttgaagtgctcgcgcagctgatccgggttgaagttcagcagcgtgccgccggtctcgaagtgctggatgaacacccggccgatggcataggtcacggcataggagacggtgggcgaaaccgcgaggccgatgacggtaccgaccaccggcaccgacttcaccaggctggcgacgccaccgaccaggccggccgcggcggtgccggggacgacggtgttggccagcgagccgatgatcgccttggcgcggttctcgctgaacggcacgtcatagagcttcgacagctcgtagatcatcttcacctgcacgcccgtgaccagagcgacgtcgagcagggggaaaggcagcaggccggcgcccgcgccccagagcgcgcaacgcttgaccagcgcgcgcgcatcgtcggcgcgcagctcgggggtgtactcttcggcgggagcagccgtcacttcggcggtggacatcgatcgcatcctcatccaggggcccggaccagtcttgccgggatcggtcggtgggtcgaaaggggaagggaggacagcccgtcatgggaaagcgccgtacgggcagggtcgcccgtatcctgctgctgatccatgcagagcctgccattcttcctctgaaacgccaacggaattcccggagacatccggttccgcgggcggtacgcctccggaccggcctccaccggcagagctgtcacaccctgcgcggtcatgaggccggccgatccttcaatctctgctgaagcagcgcatcgggcgatggcggttccaccagcaccttccgccgcttccgcgagatcagagtataaaccgcaggtatgacgaacagcgacacgaacgtaccaaaggtcatgccgccgacgatcacccagcccagttcgcggcgcccgccggcgccggcgccggtggcgatggccagcggcaccgcgcccagcacggtggcgatcgtggtcatgatgatcggccggagccgggtttcggccgcctcgatcaccgcctcggtccggtcgcggccggcatcgcgcagctgattggcgaattcggtgatcaggatgccgtgcttggcgatcaggccgatcagggtcacgaagccgatgaagctgtagatgttcagcccgccgccggtctcgctcagggtgaagatcgcacccgccaccgccagcggcgcgatggccagcacgatcaccgggtcgcggaagctttcgaactgggcgctcagcatgaagaagatgaacaccagcgccagcagcagcaccagaccggccgagccgctttcctgcgaagccttggcggcatcgccggccagcaccggcttcatgccaggctgcagcacctcgcccatcagcggcatcagagcctggaaggcttcggccagctgatgaccgggggcgaccgccgccgtgaaggtggccgagcgcagcccgtctgtgtgctccagcgtgtcggcgccgactgtgcggtgcagttccacgaaatcgcgcagcggcagcggatcgacgctcttgccgcggatttccagcgtgttgatcgtctccacctggccccgccattcgggcggcaggtcgatgatcaccttgtagagttcgccgcggttggtgaaggtggaaaccgggttgccaccaagcgccgcctgcagcgtgtcgccgagcgcggttgccgtcaccccctgctcgcccgcgccgtcgcggtccagcgtcacctccagctgcggccggtccagctccaggctggaggccgggtccgcgatcgacggcagatcgcgcgccttcgtcaccagccggtccatggtccgggccagatcgtcatagctgccggtggtggtgatcatcagctggatcggccgcgaactgccgccgccacccagcgggctgacctgcagaacatcgatccgcaggcccgggatcgccgccagcagcggcttcagcgcatcgccgatttcggtggcgctgcggctgcgctccccccagggcttcagcagcagataggcattggccgcagacggcttggggctgccgagcagggtgaggacgccggtcgcctcgggcacggttttcagcaccgcctccacccgggcgatctgatcctgaagatgatcgagagtcgaggtaccgcgcgcctcgatatcgaacaggatatagccctgatcctcgaccggcgcgaaggcgaagttcagccggctggtcgccgagaagccgacataaagcgcggcgatcacccccagcagcaccagccagcgccggtgcagcagccagcccagcaaccgggcataggcgcgggccagcgcctcggtcgcccgttccacccggcgggcatagccgtgttcggcccgtgcgccgatcagccgcgcgcacatcatcggcgacagcgtgcgggcgatgaagcccgagatcagcacggcccccgccagagtgaaggcgaattcccggaacagcatgccgatctggccgccgaccaggccgatgggcgcgaagaccgccgccagcgtcagcgtggtcgcgatcaccgcgaagccgatctcgcggctgcccaggaaggatgcggtgaaggcatccagcccgtcatcgacatggcgctggacgttttcgatctcgacgatcgcatcgtcgaccaccaggccgatcgccagcaccaccgccatcagggtcagggtgttgatactgaaatccatcgccgccatcagccccagcgtgcccagcagcgacagcgggatggtcaccagcgcgatggcgctggaacgcagcgagccgaggaaaataaccaccacgcccagcaccagggcgacggcgatcgcgatcgtctcgaacacctcgtgcaccgaagcgtcgatatagatcgtgctgtcaaaggcgatctcgagccggaaaccgccgggcaggccggcctgcagggccggcagctcggccttcaccagcctggcgatgtcgagcggattggcggtgctctgcggcacgatgccgacggccaccacatcgcggccgttgaagcggatggcattgtccaggctttccggccccacctccgcccggcccagatcggagatgcgaaccagatagcccggctcggcgcgcaccaccagccggtcgaattcggccgcggtcgacagcgccccttccaccaccacatcggtgcggtcggtacgggtgcggatttcgccgccgggcacgtcggcattctgggcgacgatcgccgcccggacatcgccgatggtgatgccgtaagaggccaggcggatcgggtcgagcacgatgcggatggcataacgccgctcacccagcagcgtcgcctgggccacgccgtccagcgccgcgatccgcggcagcagcaggcgattggcggtatcgctgatctccagcgcatcatggctgtcgctcgccaccgtcaggaacatgatcggctgggcgtcgagcgattgctgcgccaccaccggcgcccgcgccgcctggggcagcgtgtcggtcagcggcgccaccttgttgcgcacctcgttggcgagcagcagcccgtccagccccaggcggaactggatctggaccagcgacatgccggcgcggctctgcgaggtgatctgctgcacgcccgaaatgcccgaaaccgcctgttcgatcggcgtggtcagctggcgctcgacctgctcggccgccgcccccggactagacggtggtgatggtgacataggggaaatccatcgccggcagctggcggatggacagatggttgagcgcataaagccccagcagcgccaggatcaggttgatcacgatcgcgaagaccggccggcggatgcagaggtcggagatcagcatcagccgcccccgtccgccggcaccggatcgatccgcatgccgtcctcgaccttgaactggccttccacgatcaccggcgtacccgcatcgagcccggtcacaatctcgaccgtgccgccatcgccgtcggcaccgatggtcaccgggcggcggatcgccttgccgttgtcggccacatagacgtagtcgcccgagagcgacgacatcaccgccggccgcggcaccagtacagcgccctcgcggctgtcgagcaagagatcgacattgacgaacaggcccggatggatcggccggccgccgatttcggcctgggtcagctcggcacggagcaggatgctgcggctgtcgggttcgatcgagggatcgaccaacgtcacccgcccctggatggggtcggggcccaggctctgggacgagagggtgaccggcaggccggtcttcagccggggcagaagtttttccgacacccggaacgtcacccgcaggcgagagcgatcctcgaccgtcagcgcctcttcaccgggggaaagaaagctgccgacctcgatcttgcgggtgccggcgacgccgtcgatgggtgcgcgcagggtgagcaggtcgagctgggtctgcttcacctccagcgccgcccgcgaggccgcgaccgccgcccgcgactggtcgatatcggcgcgggatttggtgccccggcggcccagttcttcgtcgcgcttcaggttctgggcgtccagcgccgcggtcgcccgggcgcttgcaagctcggcctcggccacgcgctggtccagccggaccaggggctggccctgcttcaccgcctccccctcgcggaacagcacggcgacgacatggccgccggattgcggcgacagcacgatgcgtgccaccggttccaccgtgccgaaggtgatcaggcgatcataggccgtgccgcggccggccttggccacgcccaccttcatcgccggcgccgccgggggctgctggggcggcgtggcggcggttccggccacggccggccctttcgtcgcccccggcgcaggcacgccgggcacgagaccggcctgccacgcccagccggcggcaccggccaggcctgcaacgatcaccagcgtgatccagcctctcgccctcatcccactcccctgctgcggcgcaatagaccgcgaacggtcactggtccgggatggagggtgacacgacatggcatcacctgtctaccggaccgcaaccaaaaatccacttgcacgggaatatctcccggcctaccaatgggcgcaacttcatgggcaccgaaactgtggcagaatgcaccgcaccggatcccatggtcatcgatagcaggatctgcgtccgccttcacctctgcgccgtccggcgataaacgaccatcgaccggaacaccccctcgcaggttgctgcatcgccaggacagcgcctatcatcgctcgatcaccagcggaatgaagactgccgatgaccgcgccacatttcatcgcacatcaaaacatctggctggatgagcggctgaataccggaccgggctcatatcacatcggtggatatgttgaactccgtggtcctctggatatcgatatcttcggcgcggcactgaaggcggtggcggctgcacatgccggcctgcatatgcaaccggtgcccgaaggagacggttttcgtcttctcgcataccaagacaccttctcgtcacctgtcagcgtcgatctgtcgcaggagggaaatcctgcggcagctgcgaacgcctggatggcggcggatttccgccggatgtttccggccggcgcccccctgttcaggtgggggttgatacgcctcaccgccgaccgccatttctggaccaagacctatcaccatctgatcgtcgacggccacgcgatctcgcggatcgtgcaggatgccgcacatgcatacacctcgctgcttgccggccgcgtccccggcctcgccggcagcgatccgctggcgatcggtgatccgcttgcaggcgacggcgtgtcggcgcggcaccactggtcgacggttctggcagcggccccgccggtgctcaacccggtaccgcccctgccacccccggatctcggcccgccggatctcaccccgccggagcccggcatgccgggccggcgaacccggatcgggctggagcgcggggtctatgatggcctcgcccggcttgccgcacaggccggcgccggcctgccgcagctgcttctggtgctggcctctgccgccctgctccgccgggcggggcgggatgctctggtcgccggcctgccggtcgccaacaggccgaccgccgcccacaaggcggccgtcggcctgttcgccaccatgcagccggtcatcgttgcgatcgatgccaccgaccgcccgctcgatgtcgcagccgctctggcccgcaggatgcgcagcgcctatcgccatcgcagcatcgcctttgccgaacaggcggcgatgctggcggcggtgcgcggccggggcacgcccgctttcgatctcaccctgtctttcgagccgcacgactacgacgcccgcttcggcccggtgacggcgaccgcccataccctctccaccgggcgagagccgcatccgctctcgatcttcgtgcgcgactatcatgacggtgccgccgtcaccgtcgatctggactggcgcagcgacgttttcgccgccgacgacatcccggccctgatcgcccgcttcaaccggctctgccgcaggctcctcgaccagcctcaggccagcctcggccggctcgaccagccggataccgaaaccctcgtccggctcagacgcctgggctgcggccggccgccacgaccgggcgatctcgcaccgctcgccgatacgatcgcggcccaggccgccgccacccccgcagccctcgcggtggtcgatgccgcgaccggggatcgtctggactatcagaccctcgtcgcctgcgccggccgccgcgcggccgcccttcaacgcgccggtggcggccccgaaagcgtgatcggccttgcccatccttcggggatcgaggcggtgatctcgcggctcgcggtctcgatggcaggcgccgcctggctgccgctcgatcccgaggatccccctgcccgccgggcgacgatgctcgatcaggcccgtcccctgctggtgctggacgaccagtcggcccgcgctctcgacctgaccgttgccgccgatgcccggccggcagcatggccggttcatcccgaacagctcgcctatctgctgttcacctcgggctcgaccggcacgcccaagcccgtcgccgtcccgcaccgcgccctggccatgcacatggcctggatgggccggcgctatccgctcggccccgacgacgtcgtcctgcagaagaccccggccggtttcgacgcctcgatctgggagtttctggcgccgctgatggccggtgcgcggctggtgctggcgccagccggcagccatcgcgaccctgagatgatcgggcggctttgcgcagatcacggcgccaccatcctgcaggccacgccgaccctgatcgacgcgctggccgcaggcggggcgctcgcccgtgccggccggctgcgccgcctgttcgcgggcggcgagatcctgggcccggcgaccatcgccgccgcccgggcagcgctgcccgccgatgccgtcctgatcaatctctacggccctacggaatgctgtatcgacgcctcggccgccgacatcccggcggatctgcagggggcggcgccgctgggcgatccggttgacggcgccagcctgcaggtgatcgatgccgcgggcgacccggtcggcccgggggtcgccggtgaactcgccatcggcggcctggccgtcggccgtggctatcacggcgatccggtgcgcaccgcgttcgccttccgccccgaccccgaggcgaaggcgccgggcgcccgccgctatctgaccggcgatcgcgtccgccgcacggaacgggatgccctgctggcgctgggccggatcgacggccagatcaagctggccggccggcggatcgaaccgggcgagatcgaagccgcgctgatggtccatcccgccatcgcccaggcgggcgcagccctgctgccggcgaccgacggcgccgctccccggctcggcgcctgcatcgtgctccgccccggccatcctgccccggcccccgacgagctgcgccgccatctggcggcccgcctgcccgccgtgctccaccctgcgatcgtgacctccgccgaccggctgccgctgtcgcgttcaggcaagctcgaccgccgggctcttggcaaggcgatggccgacgaggtaccggccaccgccgcccgcacccgcctcgacggcccgctccaggccgaaatcgccgcgatctgggccgaagtgctcgacctgccgatgcccggatccgccgatgatttcttcgcccttggcggccactcgctgaaggccatgcaggtggcgacgcggctgcgcgcggtgttcgatgtcgaaatcggcctggaagagctgttcgaccatccccgcctcgacgatctggcggcactcgtcgccgcccggcgccgggatgcccctgcggaccccggccccgtgctcgacatcctgccggtcccggccagcggcctctgcccgctgtcgtctgcgcaggagcggatctggtttctggcccagtggccggatggcgccgtcgcctacaatatggcgatggcggtccgcatcgacggcccgctcgacgtcgcagcctttgccgaggccgcggccgtgctgcccgatcgccatccgatgctgcgcacctgcttcgcggcccccgacggcgtgccgcttcagcgggtcgaccctgaggcacggctggtgctcgcgacccgcgatctcagggatctcgatcccgcggcacgcgatgcggcggtgaccgaggccgccgcccgcgacgcagccacgcccttcgacctgacccgggcgccgctgctgcggctgaccctgctgcggctcgccgatgacgcccatgtcctgctggtcaacctgcaccacatcgccggcgacggctggtcggggcagatcgtgctggaagagctgaccgccctttatgccgcccggatcggcgccggtcccgatctgccgccggcgcccgcgctcacctatgccgatgtcgccgactggcagcgccgccgcctgaacgaggccgaagcccgccgccagctcgaccattggcggggggtgctgaccgacccgccggtgctggacctgccgaccgaccggccgcggccgccggtggtctcatcggacggcggctgccttgtccgcgacctgcctgatgatcttctggtggatctccgcaggcttgcggcaggcgccggctgcacgcccttcatggccatgaccgccctgttcggcctgctgctcggccgcatggccggccaggacgaggtcgtgatcggcacgccggtcaccaaccgtccggaccggcggctggaggatctggtcggcttcttcaccaacaccctgccgctcaggctggatctgaggggggccgatcttcccgccctgctctcccgcacccgcgccacctgcctcgccgccttcgaccatccggacctgcccttcgagcgcctggtcgatgccttcgcgcccgaacgcagcctggcccatacaccgctcttccaggtgatgctggcctggcagctggccggcgccagccggctggaactgccggggcttgccgtcagccggcttgcccccgccttcaccgccgccaaattcgacctgatgctttcggtcgaagagaccggccggtcgatgtcctggcgcttcgactatcgcgccgagctgttcgagcccgagacgatcgccctgatcgccgaccggcttatcgccctgatccgcgccgccgcccgtcatccggcagcgcgtctgccggaactcttcgaagtcccggttccgacagtgccgacgccccccgcgcccgcatccgatgtcgtcgacctcatcctcgcccgtctcgacgccgatcccggccagatcgcgctggtcgatgcggccacgggcatcagcctttccgccgcagaactggcagcccgcgcccgccgccgtgcggcggggctggtcgcggccggcatcggccccgatcgcatcgtcgccctcgcccatccccgcggggccgagctggtggtgtcgatgctggcggtggcgattgccggcggtgcctggcttgccctcgacgaggacgagcccgaggcgcgccgggcgctgatcctggcgaccgccgcccccgatctggtgctggatgccgacggcgccgcccggatcgatgccgccgccggcgatcatccgctgccggccggcgtccgccatcccgaccggctggcctatctgctgttcacctcgggctccaccggcacgcccaagccggtggccgtgccgcaccgcgcgctcgcccggcacatggcctggatgaaccgcagcttcccgctcgaccccgcagatgccgtgcttcagaagacgcccaccggcttcgacgcctcggtctgggagttccaggcaccgctgatgaccggcgcccggctggtgctggcccctgccggcagccatcgcgcgcccgagaccctgggcaggctggtcgacgcccatggcatcaccattcttcaggcaaccccgactctggtcgatgcgctggcggccacgggcgccctcgcccgcggccagcagctgcgccggctgttcatcggcggcgaagcgctgggtacccccaccattcgcgccgcgcgcaccgtgctgccgtccggctgcgcgatcatcaacctctacggccccaccgaatgctgcatcgatgccaccgcctgggtcgcggacggtctgcccgcggcgggcacggcgccgctgggggcggcgatcgacggtgtgcatctcatggtgctcgaccgcaccggccgtcccgtcccgccgggcatgccgggcgaactcgccatcggtggcgagaccgtcggccgcggctatcacggcgatccggtgcgcaccgcgctcgccttccgtcctgacccggcggccccccgccccggtgcccgctgctatctgaccggcgaccgggtgctggtcgatgcccgcggccggctgcgctatcagggccggatcgatgcccagatgaaactccgcggccagcggatcgagccgggcgagatcgaggcggtgttgagcgcccatcccgccatcgcccgcgccggggtgacggtggtgagcgccgagggcggcgagaccctggtcgcctggctgacctgccatccgggaagcgttttgcctgccgccgaggtgctccgccgccatgtcgcccggcatctgccgatccacatgatcccggcgcgcttcgttgcaaccgatgccctgccgctcaccgcctcgggcaagctcgaccgccgggcgctgaccgcccggccgctgcccgacgccgaccgcccggccggcagcgatgccccggccagcccggtcgagatcctgattgcggaaatctgggctgaggtgctggaccggccggtcatcgcgcgcagtgacgacttcttcgcccttggcggccactcgctcaaggccgtgcgcatgctcgcccggctgaacgaggcgctgccggtggaggtgccgctgcgcaccgtgttcgagaacccgaccgtggcgacgcttgccgccgccctgggcgccctgaccgatgcggcactggccggagatgacgatctcgccgccctgctggccgaaatcgaggccctgaccggggcagaggggcccgaggtagatgggcccgggacagatgggcccgaggccgaaacctttccggataccgccgcccaatgagcacgctcccgcccgatacgcctgccggccgcagcctgcttgaccgcatggccgccctcagccccgcccagcgcgcggcgctgaagcagcgtctggcggcccgcgacggggctccggcagcacctgcaacggccgtcgctgcggagacatggcccgaggtcggcgcacaagccccgctttcccccgcccagatgcgctttctgttcctggccgaagacgaggccggcgatgcccaggccatgtcgctgatgctgcgcatcgatggtccgctcgatgccgaccggctggcggcggcggtctcggacatcgtcaccgcccaggcggcgctgcgctgccggatcctgaaaaccgcccgggccccggtgcaggaggtgctgcccgcccccgcaccggccgaagcactgccggtcgtccagatcgcaccggcggaggatgccgatgccgccctggttgcggcgggcctcgccctcggccacgaaagcttcgatctcgccgtcggcccactcgcccgcttccgcctgtttcgctgtgcgccggatctgcatgggctgggggtggtgctgcaccacatcgtggccgatggctggtcggccgggctttgcctcgccctgatccaggacgcctatgcccggcggatggccggccggccgccggcaccgccgcccgcgcgttccgccttcgacgaagcccggcgtctggccgatctggcagccggggaagcgcatcgccgccgtctcgaccaatgggtcgaccgtctggccggtgcaccgcgacggctgatgctggatggcggaccgggagagccgggccccgcccggcatctgcccttccggatcaaccccgcccaggccgaagccctggccggtctcagccggcgcgtgcccggtgccacggtcttcaccgccctgctcgccgcctggggcgcggtgctcggccggttcaccgatcagggcgacaccacgatcgcggtcgcggtcgccaaccgccccgatccggcgctcgaccgcacgatcggcgaattcgccgatctggtggtgctgcggctcgccaccgccgacgatccgggcgtggacgccctgctcacccgcacccgcgacgcggtgatcgacgcccaggcccatgacggcatcaccctcgcccagatcatggaagcgatcgaccgccgccatggcgccggggcccggccggcgatcgatgccgccttcagcttcctgaacgtgccggcgcctgcggccgacgcccatggcctgcgcttccggccgctgccactgccggccgaccggctggatttcgcactctatctgacggcgcacgaagatcctgccggcggactggcgggatcgctgggcttccggcctgatctcgtgccaccggcgctcgccgccgcactcgccgacgctttcgggctggtcgtcgacgccatcagcctggacggcagcctgccggtctcgcgcctggccctgacgaccgaacccgccggcgacgatctgccggtggtcaccggccccgatggccggctgcatctggcgcccgtgggcctgccgggccggcttctgcccggccccgaccgcgcgcggcggctctccgacggccggctgcggctgctgcccggcatcgacggcgcactgcgccgcggcactgcgcgggttcatccggccgcggtggaagcggcgctgcgccgcctgcccggcgtgctcgatgcggcggtctggacccgcatcgccaccgatcacgaggcccgtctggtcgcggcggtcgcgaccggcattccgtcgatcgagcctgcgggtttcgcggccgggctcgtggacgcgctgccgctgctgctccgcccggatgccgtcctgccggttcatgccatcccgcgcgatgccgagggccggcccgaccgcgccgccctcgaccggctggccgtgcccgcggccccgcaccggacggatcaggcggccctggtctgggtggaggcgccggcccccgctctgccgcgcctgccgctcgacagcctgcccggcaccgccggagcggcggatgacgcgggctggctggtgccgggcgacccgccgcctcgggcgctggccgatggggggccgctggttctgcccgccgatgccccgcgcacgctggatgccgccctgatcgcaaccgccgcccgccatccggggcgcggcattctgcatgacgacggccgcggatcgccacggcttcaggattatgccgggcttctggcggccgcccgccgcacgctcggccggcttcaggcagaaggcctgcgtccgggcgaccgggcggtgctggtcttcgccgaccttccccgtcatatcgaggcgctctgggcctgcattctgggcggcatccggccggtgacggtcgccgtaccccatgccgccggcgatgccgtcgcggccaagctttcgggcacccatgcgcatctgggcgcgccgccggtgctgaccgataccgacacccgcgatcatctgagccggatcctgcccgacgcccggatcctggtcgccgcccccgacaccgatacgcctgacggggttccccatccggccacccccgacgatgtcgccttcatccagctctcctcgggctcgaccggtgtgcccaaatgcatccaggtcacccatggcggggtgatcgcccatgtcttcggccaagtcgccgcctgggggcacgggcccgacgacgtgtcgatgaactggctgcccttcgaccatgtcgtgccgatgctgacctgccatctgaaggacacggtgctcggccgccagcagatccaggcccccaccgcggcggtgctggaccggccgctgctctggctcgatctgatcgaacgccaccgggtgacgctggcctgggcgcccaatttcgcctttcgcctggtcgccgacgccctgtcgcgtgagacggggcggcggcgcgacctgtcttcgatccgctggttcatcaatgcgggcgaacaggtgactgcaccggtggtcgccgatgcgctggcggccatggtgccgcatggcctgcgtcctggcgcggttcgcaatgaattcggcatggccgaactctgcacggtgatgaccggcggcatcgacttcaccgcagacggcgcctgccgccatgtcaccgccggatcgctggccggccggctgcgcgccgccgcgacgcccggccccggcacggtcagcttcgtcgatgccggccggccgatccctggtgtcgcgatccgcatcgccgatcccgacggcgccacctgcccggaaggcgtgatcggccggcttcaggcgcggggtgccgtcaccacccccggctatatcgacaacgccgccgccaatgaagcggccttcgccgatgccggctggttcgacaccggcgatctgggcttcatcgccgatggccgcctggtgctgaccggccggctgaaagagatgatcgtcgtctgcggcgccaatcactatgcccatgacgtcgaagacgaggccggccgcgcggcgggggtcgccgccaccttcgtcgccgccaccgccgtcgaccgccccgatctcggcaccgaagggatcgccgttttctacgtgcccgaggcttgtctggccgagatcggttccgccgatgatgccggcccgcgccgcgccgaaatcgccgagatcaccgcccgtctcgcccgccggctcggcatcgcaccctcggtggtggtgccgctggagcgggccgatttccccaagaccaccagcggcaagatccagcgcaccgccctgcgccaccggctggaagcgggcgatttcgatgcccggcttgccgccctcggcctcaccccgggccgcgatcgggggccgggcctgcccgactggttcctggagccgggggatgcccccgccccgccgcttgccggcgccccgcggcttgggctgatcgaagaccgcctgccgcgcggcatggcgctggccgatgccatcgaccgccggcgcgcgctactggcccgtctggccggccagactgtcgagctggtcaccgtgacacccgccggcgacgtcaccgccgccgcggtcgatgccttcaccgccgccgcggccgaggagctgcccggcctgcatctgcgtcggatcgtcatggccgacggcacgcccgaagcgctcatcaccgacgagattgcccgtggcaccctgccggtggtccacctcgcggccggcggccgcacccggccggtgctgcacccggcgcggctcgcccccgacacccctgcccaaggtatcgccccggggcaatcctggctggtcaccggcggccatggcgggcttgggcgggccctgatccgccacctgctcgatcgcggcgtggcctccgtcaccgtcatcggccggcacatggcgacggcggatgacccgcgagtccatgccctgtcgctcgatcttgccgccgccgatgccggcgcgcggcttgcagtcctcggccggttcgacggcatcgcccatctggcggggctctatcgcgagcggccggcggccgaagaagacggcagggcggtggccgagctggcggcgcccaagaccggcatgctgccggcgcttgcccgcctgctgcgggatgacgggctgctgatcgccttctcctccgtcgtggcccatctgccggcggccggcaccgcggcctatgccgccgccaatgccgccctcgaagccgaagccgctgcgctgcgccggcccggcgggccacacctcgtcaccatcgcctggacgaattgggacgggcccggcatgggggcggccgtcaccggtgccgccggcctcgcccgcggccgcggcctgctgcccatcccgcccgccgacggtctggccagcctggatgtcgtgctggccgccggcctcacccgcgcggtgatcggcgccgatcgccgccatccgatgatcgcggcccgttgcatcgatccggaactgtcccccgcccgcgcccgcgcggtgctgctggtggcaggtgagacggctgccccggcgacgctccgccgggccgaagacatcttcggcacccctgccggccccgggctccgccatgtcgaccatctgccggaaagcgacgacgcccttgtggtccttgccgccggcggcgacaccatcgcggccgtggcaccccgcacggcgaccgaaaccgcgctcgccgcgatctggtcggaactgctgccggcaccggtcgccggcatcgatgccgatttcttcgccgccggcggccacagcctgctcgccgcccggatcgtcacccggatcaacgaccatttcggcctgcaccttaccccggccgcgctgttcgatgccccgaccatccgggcgctggcggcgcatgtcgacggcgttgcggcgcccggcccggccggggccgacgaggatttcgaggagggcgccctgtgaccgccaccgacctgctcgcccgcgtcgccggtgccggcatccagctctggtccgagaatggcgagctgcgcttccgggcaccgaaaggagcgctgaccccggaactgcgggccgagatcggggcgcgccgcgccgagttgatcgcgcttctggccgaggcagccgccgtcgccgcggcggatgaccgcgacccgctgccctccttccggcctgaactggatgatgagatcccgctcgcccccggtcaggcccgctggtggttcctcgaccggctgggcgccgatccgagggcggcgctgatcaccgcggcgctcgatctcaggggctcgctcgacatcgcccgcctggcccgggccttcgccgacatcgcccgccgccatcagccgctcaggaccgcgatcctcgatcatcagggcacgccgcgcgccgtgctccggccggtgcccacggcctggccgctgccggtgaccgatgccgccgacgacgccacggccgatgcgatggcgcgcgagattgccgcccggccgatcgatctggcggacgggctcaacctccgcaccgcgctcctccgccaggcgcccgatcatcaccgactggtggtggtgctgcaccatgccgccgccgatggctggtcgctgggcgtgctgctccacgaggtgcaggttctgtatgacggcggcacgctgccgccgctccgccgcagctatgccgaggtgatgcaggatcaggcgcggatccgcgccgccgatctcgatgtctggcgcaagctgctggccgatctgccgccggcgtccgatctcgttctgcccgggcatcccgagccggccggggacgacccggtgatccggcggcgtctttccccagagacgtcggcccggctcgacgccctcggccgcgggctgggcgtcacccccttcatcatcctgaccgcggccgcccagatcctgatcggccggctgtcgggcagccacgacttcgccctcggcaccccggttgccaaccggcccgatgccgatgccgaggcgctgatcggcttcgtcaccaacacgctggtgctgcgcgccgccctcggccgggcgcgcacggtgcgcgagctgctcaccgccatccgcggcgacacccgcgacgcgctcgcccaccagtcgcttcccttcgaccggctggtcgacgcgctgggcattgcccgcaccggcaccgacaacccgctcttccgggtgctggtcgcggccggcgccgccgatctgccggcgccggggctgggcggtctcgacgtcgccattctgcccgccccggccacgagcacccggctcgaccttgaaattcacggccatgccgggcccgagggcttcgatctggcggtcactttcgatccgacccggatcggccgcaccgctgccaccgacctgctggaccggctgggtctgatcctggacggcatggcgacccgccccgatgaagcctgggccgacctgccgatcctgaccgcggccgaggccgcccgcatcgatgcggcggcccgcggcgccgccatccgccacccgcgggtgctggacgaaatcctggcccgcgcggccgaggctcccacggcaccggctttgatcgacgcccatggcagcctcgatcgccgccgtctgatcggccgcgccgccgcgctcgccgggcaactcggcgccgtgcagggtgcaccggtggggttgatgctcggccgcggtcaggcccatggcatcggcctgctgggcgcctggcttgccggtgcgggggccatgccgctcgatcccgagctgccggatgcccggctcgcgaccatgatcgccatcgcggaaccggccgcgatcgtcgccgatgcggcagagatcgaccggctgcgccggctgaccgaccggcccgtccttcctctgccggaggccaccgccgaaacccggccagtcgcgacatcgcccgacgacctcgcctatctgctcttcacctcgggctcgaccggcacgcccaagggggtgcgagtcgcctggcgcacgctcgaccagctgatcggctggcaccgggcccgccatcccgtgcccgcccgcaccctcggcttcgcgccgctcggcttcgacgtctcgatgcaggaagcggcccttgcctgggccgagggcgggacgctggtcaccgccgacgaggccacccgccgcgacccggcggcgcttgccgccttcatctcgcgtcacgacatcgcccggctgttcctgccggtggtgatgctccatgcgctggccgaccatctggccgaccatcccgaccggacccccacctcggtgcagatgatcgcgaccgcgggcgagcagctgcgcatcaccgccccggtccgcgactggtgccggcggcagcccttcgccatcgacaaccagtacggcccgaccgagacccatgtcgtcgccgccgaactgctgccggccgccaatgtcgaccgctggcccgaccgcccggccatcggccgcccgatcgacggcgccacgcttttcgtcaccgacccggccggccatctcctgcccgacgaggtggcgggcgaactgctgatcggcggaacggccccggcgctcggctatgccggcgatgccgcccgcaccgcggaacgcttcgtcaccggccccgatggcggccgcgcctatcgcaccggcgaccgggtgctccgccatcgcgacggccggctcagctatctgggccgggccgacgaccaggtgaagatccgcggtttccgggtcgaaccgggcgagatcgaggcggcgctgggcagccatccggatgtcgcccaggcgctggtggtggtgcggacgatcgccggccaggcgacgctggtcgcccatgtcgagccgcgcgcacgccccgccgacgagaccggcttcgctcaggcgctcgccgaccatctgcgtgcccgcctgcccgagccgatggtgccggcgcgctgggtgatcagcccggccctgccgcgctcggccaacggcaagctcgaccgccgggccctgccggccacggacggcatgccgctcgccgccgccacggccgcgccgcccgccaccgaaagcgagcggcggctggcggcgatctgggccgaaatcctggccctgccggtcgatgcggtgtcgcgcggcgacgatttcttcgccctcggcggccattcgctgcgtgccacccagctgatcgcccgcatcggccgcgatctggggctggagcccggcgtcgcccaggtcttcgagaccccgcgcctggccgacctcgccgccgccctcgatgccctgacgccggtcgcccggacggcgccgatcccgcgccgcacggacgacgacgacctgccgctctccttcgcgcaggagcggttgtggttcatcgaccagttgagcccggcgcgcggcgcctacaacatgccggccgccctgcgcctgaccggtcggctggaccacgatgccctggcgcgcgccttcgccacaatctgccgccgccatgccgtgctgcgcaccgcgatgatcgagcgcgacggccggccggtgcagcgcatccatcccgcacccgagacctggccgctgccggtggaggatctctcggacctcgccgatcccgaggccgaggtggtcgcccgcgcggtcgaagatgccgagacgcccttcgacctcacccggccgctcaagatccgcacccggctgctgaggctgggtgagagcagccatgtcctgctcgccaccctccatcacatcgcctccgacggctggtcgatcggggtgatggtgcgcgagctgggcgcgctctatgccgctttcgccgccggccggcccgatccgatgccgccgctcgccgtcgactatgccgatgtggcgctctggcagcgcgcccgcctgtccggggctgaacgcgaccggctgctcgaccactggcgcagcgtgctcgacggcttcaccgccccgaaccggtcttcgaccgcccccggccggcggtgcagagctatcagggcgcgctgacccgccggccgatgccggcggcacttgcccgccatgtcgacgagacggcgcgccgccacaaggctacgcccttcgtggtgctgctcgccgccttccagctgctgatcggccgcatctctggcaccaccgacgtggcagtcggctcgcccatcgccaaccgcacccatcccgataccgaggcgctgatcggcttcttcgtcaacgccctggtgctgcgcagccgcttcaacgacgatccggacttcgccgccttcaccgaccgggtgcgccaggtggtgctcgacgcccaggaccatcaggacctgcccttcgaagtgctggtcgaggcactggagcccgaccgggcgctggatcgcaaccccctgttccagatcgccttcgcggtccagaacgccgaagtgccgccgctcgcgcttgacgggctcgacatcagggccgtcgagcgcgaggtgacccgcacccgcttcgatctggaactccatgtctggccgtcggagaccggctacgacctggtcgcctattacgccaccgaccttttcgacgcggccaccatcgaccggctgctcggccgctacgaaaccctgctcgccgccgccctggcccggcccgaggccccggtctcgatcctgccggtcgcgaccgcggatgaaacggccgccctcgccgcgctccgtgccggcccgccggccgcggccttccgtcccgtcaccgccgaaattgccgaccgggcggccgaggcccccgcggccccggcgatcctgcaccagggcgcgcccctctctcgcaccgatctggaccaggccgccacccgcctcgcccggcggctgatcgcggccggtatcgggcccgaagaccgggtcggcctgctcttcgaccgctcgcccgctttcgtgatcgcggcactggcggtgctgcgtgcgggggccgcctacgtcccgatggtgaccgactatccggacgagcgcatccgctggcagatcgccgatgccggcatgcgcgcggtgctggccgccgccgatcaggcaccccgcatcggggatgccgtgccggtgctggtaccggacgacgatacaggtgacggcgatgccgcggcccggctgcccgatccggcgggcatcgatgccgaccgtctcgcctatgtggtctatacctcaggctccaccggtcggcccaagggggtggccatcacccatggcgggctcgccaatctggtcgcctggcaccggcgggcctatgcacccgaccagaccacccgcatggcccaggtggccggcctcgccttcgacgccgccggctgggagatctggccggcgctcgccgccggggccgccctggtcctgccccagccgggcgccggccgcgatcccgacctgctgctggccgatttcgtcacccatcgcgtgacccaggccttcgtgccgacgccgcttgccgccccgctgctctcgcgccccaggcccgaggggttgaagctcgacctgctgctgaccggtggtgagcgcctggcgacggcccccgagatgcccggcgtgcggctgatcaaccattacggccccaccgagaccgcggtggtcgcgaccgccggcccggtcgatccggcagagatcgccgccggccgcgcacccgccatcggccggccgatcgacggcttcaccgcccatgtcctggaccgccggatgcgtccggtgcccttcggcgtggcgggtgaactctggctgggcggcgccggtctggcccgcggctatctgggccgggcggaactgaccgccacggccttcctgcccgacccgttctcgaccacccccggggcccggctctaccgcaccggcgatctggtggtgcggcgtgccgacggatcgctcgatttccgtggccgcgctgacgcccaggtgaagctccgcggccaccggatcgaaccgggtgaaatcgaggcggcgctgcgcgacgatccggcggtcgccgaggccgccgtgctgctggcgccggcaggcgatgcccaggccgccgcccggcttatcgccttcgtggtggcggacaccgccgccgacgaggccgaccgtgccgcccgcgaggccgagcgcgccgaggactggcgccggctttatgccgatacctatggcgcgctggacggcgacccggtgtttcgcatcgccggctggaccagcagctatgaccgcagcccgatcccggcccccgaaatggccacctggcgcgatgccacggtcgccgccatcgagcggctgggcggagagacggtctgggaaatcggttgcggcagcggtctgctgctctggaagctggcaccgcgccgccgccgctaccatgccaccgacttctccgccgaggcgatcgcgcatctgaaggccgatctggcccgaagcggcatcgatcacgtcacgctggagcgccgtgccgccgacgacatggccgaccggcaggcaggcccctgggataaccggccggcgggcccctgggatgcgatcgtcatcaattcggtcatccagtatttcccgggcgaggactatctgctgcgggtgctgcgcggcgcgctcgatgccatcgcgcccgaaggcgcgctctttgccggcgacattcgcgccgcccatgtcgagcgcggtttccagacctcgatcgccctgcatcaggcccccgcggccaccccggcggaggcgctctcagcccgcatcgccgatgccctggcggccgaaaaggaactgctgatcgacccggcctggttcctgacccgcgccgcggcactgcccggtgtggcagggatggacatccggctgaagcgcggccgcgaccgcaacgagatgacccgcttccgctatgacgtcaccctgttcaagggtgcggctcgggcgccgctggtgcccgaccggcggatggtctgggcggacggccccgatttccccgccctctgtgcgcgggtggcggcagagggtggccggatcgagatcctggacctgcccaatgcccgcactgccgccgacatggcggcggccgaccggctggacggccgccatgccacggcgggcgacatcgccgcggccgcagccgaagcggcgcgggatgccgtggatcccgaaaccctctggtcgatcgccgatgaagccggcgtcgccctgcgcatcacctgggccgaggatccggccctgatgcatgtgctgatcgaacccgccgccgtggccgaagatccgcgcccgccgctctgggcgccctggcggtcgatgccggcgcgcagcccgatcaacgacccgctggccgccggtgccgaccggcgcatgatccgccgcctgcgcgaccatctgcgccgccgcctgcccgaggccctggttccagccgagatcaggctgctcgaccggctgccgctcacccccaacggcaagctggatcgggccgcgctgctggcacggctcgccacccgacagaccgccgcccccgagaccacgaccgcccccgccggcgccaccgaggcgaccctctcccggatctggtgcgaggtgctgggcgtggccgccatcggccgtcacgagaatttcttcgaggccggcggcgattcgatcctgtcgatccaggtcgcatcccgcgcccgcaaggccgggctgccgctggccgtccgcgacctcttcgcccatcagaccctggcggaactggccggggcgctggacgcccgcgccgaaaccgatgccggccgcgatgcctgtctgccggtcgacggccccgtgccgctcacccccgtccaggcctggttcctggaccgggaaccggtcgatccgcatcacttcaaccaggcgatcctgctgaccctgccggccggaaccgaggatgcggcgatccaggccgccgtacagacccttgccggccgccatgatgcgctgcgcctgcgcttctccccagacggcagcggccggatgatgcagcaggcgggcccggtggacggtgccacccggttcgacagcatcgatgcccgcttcgacgactggagcgcccatgccgcccgggtccaggcggggctcgacctcgcccgcggcccgctgctcagggtggtgcgctaccggacgggtgccggggccgaccgcctgctgattgtcgcccatcacctggtgatcgacgcggtgtcgtggcggctgctgctcgacgaactgcgcgagctgctggcgggcggcggcggcgccgatccggcgccggccccctccttcacccgctgggcggcggcactggccgatcgcgctgcccgcggcgccttcgacgacgagatcccgcactggcaggcggtcgcccacgccgcgacctcggcggcgggcctgccagtcgacgacccggccgcgcccgatctggtcgagcgtgcccgcaccacccatcgtgcgctcgacgaggctcgcaccgaccggctgctgcgcgccgccaaccgggcgctacgcaccgaggcagccgagatcatcaccgcggccgtcgcccgcgcgctggcccggctgacggccacttccctggccaccgcccccggcccggtcaccctgctgatcgaccgcgaaggccatggacgcgaggatctggtgccgggtctcgatcccgcccggatcaccggctggttcaccgccattcacccggtggcgctgatcgtcgatccggccgagccgccccgggccagcctcgcccggatcaaggacacgctccgcgctgtgccgcgccggggcgccggcttcggcccgctcatccgcgccgggcggatcgagaccccgccacccgcgcccgagatcgccttcaactatctgggccaggtcgatgccgcactcgatggcggcggcctgctggcggcggcaccggaaccggtcgggccgctacagagcccggcggccacacggttgcatgcgttgaccatcggcgcggcggtgatggcgggccggctcagggtcgaaatcacctggcccggcgaccgcatcgccgccgcccgcatggagcggctggccgatgatgtggtggccgaactcggcgccctggtcgatgtctgcatggcggccgatgccgccgggctgacgccctcggatctgccgctcgccgggctggatcagccgggcctcgatggcctgctcgcccggctgccgatcccggcggaggcggtggaaaccgcctggccggcaacggcacttcagcacggcctgctgctgcaaggcgcgcgcggcccggccgagggggcggcgctctatgtcgaacaattcgccttccgcctgcgcccgcccgtcgacaccggagcgctggtccgcgcctgggatctggtcaccgcccgccaccaggcgctgcgctcgctgatcctgcacgaggggctggagcggccgctggtggtggtcgcgcgacaccacaggcctgagatcgcgaccagcgaccatcgggtgcttgcaccggccgcggccgaagcggcgctcgatgccgcactcgcccgcgaccgcgccacccgcttcgatgccgcccgggcctgcccctggcgcctggccctgcaccggttgcccggggatgccggctctgatgaagatgtcggggcgggcgacatcgtgctggtctggagcttccaccacgccctgctcgacggctggtcgaccttccgggtgctggaagaggtgctggccgcctataccgccctcacccgccgcagtacgccggatctggcgcccgccgccccgctcgcccgcttcgccgcctggctcgccgcccgcgatccgctggccgaggagacctattggcgggcagccctcgacaatctgcccgagccgcagccgctgcccgggggccgccccggcgggtcggcgacggcagagcgccaccacgtcaccggccgcctgcctgccccggcggcggcacggatcatagaggccgcccggctgctgaaggtgacgccggccaccatcgcccaggccgcctgggcgatggtgctggcccgccatggcgaccgcgacgacgtcgtcttcggcaccacggtctcgggccggcccgaggcggtggcagaggtcgaacgcatggtcggcctgttcatcaacacggtcgccgtgcgcgtgcggatcgatcccgcccgccgcatcggcgactggctggccgagcttcaggaaagccgccgcgccgccaccgccttcgaggccgcccccctgggcctggtccagcgctgggccctgccgggagagcagcgccggccgctgttcgaaaccatcctcgccttcgaaaactacccggtcgccgaggcgctgaagggcgatgccgccaccccgccggtgctggacgtcgccgacaccgtctatgagggccgcacggaatatccgctgaccgtcaccgtgctgccgggcgacgggttcgcggtagacatcgcctatgatccggggctggtcgatgccgatgcggccgaccggctgctcggccagatgctgaccgcgcttgccggcctcacccgggatcccctggcccggctggccacagtcgacgtgctggatgcggccgagcgccggctgatcgccgactggtcgcagggccgcggcgcggcggcgatcgcggccggcttcgccggggatccggcaccggttgccgatgacgaccggccattgcatctgcgccttgccgaccatggggccggggagccggcgctgatccaaggcgatcgccggctggatcgcgcttggctcgacaccgccgcccgccgggtcgccgcccggctggttgcggcaggtgtgggcaagggcgatctcgtcgccctgctgatgccgcgctgccccgaactggtcgcggccatggtcggcatccatctggccggcgccgcctatctgccgctcgacccggtttatcccgatgcccgcattgccgcggttctgggccatgcccggccgcgggcggtgcttgcggatatggcggggctcggccgtcttcacgacctggccggcgccccggcgctgcggctggatgtcgccgccgtcaccggcaccggccccctgctccacccgctgccccaacccgccgcggactggcgggatcagcccgcctatgtcatctacacctcgggatccaccggcacgcccaagggcgtggtcgtcaccctcggcaatctcgcccggctgatcgatgccacccggccctggttcgatttcggacccggggacgtctggaccctgttccactcccccgccttcgacttctcggtctgggagatctgggggccgctcgcaaccggcggccggctggtgatcgtcgatcacgaccaggcccgcgacccggccggcttccatcgcctgctggcgcatgaaggcgtgacggtgctgaaccagacgccgagcgccttcgcagccctcgacgcggccgatgccctggcggcaggcgtcccggccggcccggcactcgatacgctgcgtctggtgatcttcggcggcgaggccctggatgccgcaagccttgccggctggttcgcccgccatggcgacgaccgcccggcgctggtcaacatgtacggcatcaccgaaaccaccgttcatgtcacccatgcccggatccgcgcgccccacgccgctgaaaccggcacggcgccgatcggcgtgccgatccccgatctcaccctgcaactgctcgaccatcaggggcgcccggtgccgatcggggcggcgggggaaatccatgtcggcggccgcggcctcgcccgcggctatctgggtcgcgacgacctgacggccgagcgtttcatcaccaccgccgacggcacccggctctatcgcagcggcgatctcggccgctggcgcagcgatggccggctcgatcatctggggcggatcgacgcccaggtgaagatccgcggtttccggatcgaaccggccgaaatccgcgcggccctcatcgcccatccggccatcgccgatgccgcggtggcggcccgggccggcggcgcggatggggaattgcggctggtggcctggatcctggccgacgaggtcccggaagatctgcgcgaccatctgaaggcccggctgcccgactggatggtcccctccgcgatcatgccggtggcggcgctgccgctcacccgcaacggcaagctcgaccttgccgccctgcccgacccgtcaccggtcgccggcagcggcggtgcggcgcccgccacggcgaccgaagcccggctggcccggatctgggaagagctgctgggcgtgccggcacccggccgccgtgatgatttcttcgccctcggcggccattcgctgctgctcgcccgcctcgcccaccggattgcgcgggaattcggcgtcaccctggactggccgaccctcttcgccgccaccagcctcgaagcccaggccgacaggatcgagggcctggccggcagcgatggcctgccgccgctgcgcccggtgccgcgcgacggccggccgctgccgctgtcggccgcccagcgccggatgctgttcctgaacgaggccgcccccggcccggcgcacaccatcccgctgctgctcggcctgaccggccctctcgatctcgcccggttgcaggcggcgatcgacgggctcatcacccggcacgaggcgctgcggtcgcgcttcccgaccgtggccggccagccggtccagctggtggcgcctgcggaaccgcagccgctggtcgtggtcgagcccgaggatgcggccgaatggatccgggccgaactcgcccggcccttcgatctggcgaacgagcccgccttccggtgcaccctgctcaggcgtgggcggcaggatcatgtcctggtcgcctgtctgcaccatgtcgcgggtgacggctggtcggtcgggctgctggcgcgcgatctgggcgcgctctatcagggcgacgccgacctgccgccggtggtgatcggatcggccgatctgggtgccgccgaggccgatccccggcggatggcggcggtggatgcggcgctggaccggcgcgccgtggccctggccgggctgccggtgctggacctgccgaccgaccggcccagacccgacatccgtcgcggcctgggcgcctgccacgggttcaccctgcccgccgccctggcagaggcggcccgcagccttgccaccgcccggggcacgacgacggccgtggtgctggcggcggcccaggcggccctgctcggcggccttgcccaggccgaccgcttcgccatcggcctgccggccgcagagcgcctggcgcccgagaccgccgagaccgtcggcctgctggtcgaaaccctggttctggcggtggatctcggccaggtcagcggggccgggctgatcgaccggctggcggccgagatgcgcgccgcgctgggcgcgcggccgctgccgctcgaccggctgatcgaccggctggcgccgccgcgcgatccggcgcgcacaccggtcttccagaccatgttcggccatgaacgtctggccgcccacgggctcgacatgggccccgatctggccgcagagctgctcccggcgcccatggccggcgcccgcaccgatctcaccctgatcctgaccgaccgtgcggatggcgggctggacgggttgatcgaatacgacaccgacctgttcgaagcggcaaccatcgaccgcctggccaccggctatgcccggctgctggccgccctgatcgcggcgcccgaccggctggtcgcacagctgccgctcggcgacccggccccggccgtccccgcatcggccccgcggcctgccggcccggctgcggcgttccgcgccgtcgtggcggcccgcacgcaggcgatcgccatcagccatgccgacggcacccggatcgactatgccgatctgctcgaccgcgccgacaggctcgcccgcgggctgacagcccgggggctccgccccggcacccatgtcgggctctatgccgaacgttcggtcgcgggtatcgtggcgacgctcgcgatcatgctggcgggtgccgcctatgtgccgatcgatcccgcctatccggccgagcgtcaggcgatcctcgcccgggatggcgggctggaggcgctgatcctgccccgaaccgcccccctgcccgactgggcggccggcgttggccggatcgttcggatcgaccaggatggccgggtcgatcggcatggcagcggcgatctgcgcatcaccggcacgcccgcccccgacggaccggtatcgccggaggccgtggcctatctgatgttcacctcgggctccaccggccggcccaagccgatcgcggtgccctggcgggcggtgatggtgcgtgcgatcgccggcggctatgccgcgatcgggcccgagacggtgatcccgcacatctccaatccgtccttcgacgcagcgaccttcgagatctggggcgcgctgttcaacggtgcccggctgcatctcgtcgatcagccggtgctggtcgatccgggccggctggccgatgaactgacgactgccggtgccaccctcgccttcgtgaccacctcgctcttcaaccgcatctcggaacaggcgcccagcgctttcgcggacttcgatcgggtgctggtcggcggcgaggcggtgcagatgcgctggatccgggcggcggcggccgcctgtcccgccacccgcttcgccaatatctacggccccaccgaaaccaccaccttcgccacggtcttcgacatcgacgatgcggcgatcgatgccgccccgatcggccggccgatcgccgacaccacagcgcagattctggaccaccatctccggccgctgcccgatggcgtgcccggggaactctgcctgggcggcgccggccttgcccatggctatccgggcgatccggtgcgcacggcgctggccttcgtgcccgacccgttcgccaccaccccgggggcgcgtctctaccgcaccggcgaccgggtggtgcgcgatgcccggggcaggctccgctatctgggccgccgcgacggccagatcaagctgcgcggccatcgcatcgagcccggagaaatcgccgccgcggcgcacaccgttccgggcgtggcccaggcccatgcgatgctgcgccgggacgacgacacaccccggctggtgctctacgcaaccggcaccaccaccccggcggcacttgcaaccgccctccgcggcctcctgccgcgctggatggtgccctcggcggtgctggtgctcgacagcctgccggtcaccgccaatggcaagatcgataccgcccgtctgccggcaccgccggcggtcgcagcggacaccgtggcggcgaccggcggcggcaccatcgaccggctggcggcgatctgggccgccctgctcggccatcgcacgttcgggccggccgacaacttcttcgatgtcggcggtcattcgctgctgctggtcgatctgcgtgcccgcatcgccgaggagctgggggtgacgctggccatgaccgacttcttcgccgccccgaccctggccgatctggcccggcggatcgacgagggcgcgacgccggcgacacctgcccggccgggcgccgccgccgatcgcctggacggccgcagccgtcttgccgcccgccgccgcagaccctgaaccccgatccgaaggcccctgccgatgatccccgccgacgaccacagcatgaccaatgccgggaccgcgccgtcgcccaccgacatcgcgatcatcggcatggcctgtcgcgtgcccggcgccgacgggcccgaggcgctggcgcggctgctggccgaggggcgcgagggcatcgccgatctgcccgccgatgacggcatcgacgatccgcgctgggtgcggcgcaaggggctgctggccgatcccttcggcttcgatgccgggctgttcggccatgccccgcgagaggcggcgctgatcgacccgcaggcgcggctgctgctggaactgggctgggaagcgctggaacgcgccggccagccgccccgggcaaccgagggccagggccgcaccgccgtctatgccggcgccggcatcagcacctatctgctgacccatctgctcaacaatcccgcggcggccgatctcgccacacccttcgaggcggtgctcgccaattcgggcgacagcctggtgacgcgcatcgcctatgagctggatctgcgcggcccggcggtggacgtccagaccgcctgttcgacctcgctggtggcggtgcatctggcggtgcaggcgctgattgccggcgaatgccggatggcactggccggcggcgcctcgatcgacctgccggcgcctgccggctactggtacgcgcccggcatgatcctgagccccgacggccattgccgggccttcgcggccgatgccgccggcacggtgccggcctcgggcggcggcatggtggtgctgaaacggctggtcgatgcgctggaagacggcgaccacatccatgcggtgatccgcggctccgccaccaacaacgacggcgccgcccggatcggcttcaccgccccgggtgtcgagggtcaggccgaggtgatcgccgaggcgctgacgctggccggcattgcgtccgagcagatcggcatgatcgaggctcatggcaccggcacaccgatcggcgacccgatcgaggttcaggcgctcacccgcgccttcgggcccgaggtgccgcgcgggcagtgcctgctgggctcgatcaagagcaatctgggccatctgaacgcggccgccggcgtggtcggcctgatcaaggcggtgatggcggtcgaggccggcatggtgccgcccaccctgcatgcggaccagcccaacccggccctcgacctcgccgccacgcctttccggctggcgacggccctcagcccctggccggcgatccccgggccgcggcgcgcgggcgtcagctccttcggcatgggcggcagcaatgcccatgtggtgatcgaacaggccccgccgcaccccgtgcgcccggccgccccggcccggctgctgtgcttcgcggcggcgaccgccaccgcactcgaccgcatgagcatggccccgatcccggcgacggccgatgccggcttcaccctgcttgccggccgggcgcgtctgccgcatcggcgggtgctgctgcagctgccggatggcgggatggagacgatcgacggtcaggcccccgaccagccggtgaccgtggcgctcgcccggcccgatgccgccgtcgccgccggtctggcggccctcggcctggacctcagccccgatggcacgctgatgctggaggtcgagggccgcgacgagaccgcgctcctccgcgccgtcgcccgcgcctggacgcagggtgccgacatcgatgccgtccggctctacggtcccggccgccgccggctgccgctgcccggctatccattcgaacatggccatcacgagatcccgcgccccgccgccatgccgaccgcggccgatccgctggccctgccgcccaggctggccgatccgaccgactggttctggctgccggtcagccgcgaaatcccgccaccttcggtcgaggcagaggcggcgggcgccgtcatcaccggcccggtgctgatcctggcggacgcgctgggggtgagcgcgatcctggccgatcggctgcgggcggccggccacggcgtcaccctggtcacgcccggcagcgcgttcgccgcggcggggccggaccgtttcaccctggatcccgcggatccgggccagttccgcagcctgatcgcagcgctcgacgccgagccgcgcaccatcctccatgcctgggcgctgagggggccgaggccacccgccgccggggtcgagaccatcgccgcggtgcagagccgggggctgcatgccctgctccacctgcttcaggccctgggcagcccgggcacggggccggaacgccggctgctggtggcggccgaccggctgctgccggtgacggacaacgacctccggcccgatcacgcgccgctgctgggggccgccaagatcgtttcgcaggaatacgaccgcatcctctgccggatggtcgatcccggcaccgccgcaccggcgcggctggccgatatccttttggccgagctgaccgagggggcggaggcgccgcgcgtgaccagctggcgcggcggccggcgcttcgtcggcgaagaagccccgcgacggctgaccggggatggccgggcgcgtttcgtgcccggcggggtgacggtgatcaccggcgggctgggcggcatgggcctcgcctttgccgaagaggtggcggagcttgcccccggcggggcgctggtgctgatcggccggtcggtcttccccgaccccgaagactgggaggactggctggtcgagaatggcgagaccggccgcatcgcccgcagcatccggcgcctgcaggcgatcatcgcccgcggcacacggctgatggtggcgaccgccgatgtggccgatgccggcgcggtcgaggcggttctggccgaggcgcgccgccgcttcgggccgatcaccgccctgctgcacaccgcggccctcgccgattatgaaggcgtgatccacggccgcgcgcgggcgcgcaccgaccgggtgatggccgccaagcttcagggcacgctggtgctcgaccaggcgacgcggaacgatccgctgaccctgttcctgctctgctcctcgctcggcaccgtgctctaccatgtgaagttcggccaggtcggctatgcggcggcgaacgagttcatcgacgccttcgcccgggcgcgggccgccgaccccgcccgccccggcgccacagtcgcgatccgctggtcggactggcgcgacagcggcatgtcggtggcggcgctcgcccgctgggcggagcgcaccggcatcgacgagagcgactatatctcggacggtctgaccgatctggaaggccggctggccatgcgccgcgccgcgggccaggcggcgccgctgatcggggtgtcgcagcacgacctgcggatgctggttgcccaggatccgctcagggcaaaagccttcctggcggagaccgatcgcgcccatgcaaggccggcgctggcgcaggattacgtggcgccgcgcacggcggccgagcgcgaggtcgcacggatctggcagcggctgctgggcatcgaccgggtcggcgcgctggatgatttctatgatctgggcggccattccctgctcgccacgcaggttctgtcgcggatcaccgagcggctgaaggtcgaggtgccgctggatgccttcctggacgatcccacggtggaagcgctggcagggctgatcgacgcggccgaggcggcccgtgccgccaccaccgccgcggccgggagcctgccggccgaaactgcggatgatgacgggccgatcccccatgccggccggccggcggaggggctgccgctgtctttcgcccaggcgcgctgctggttcctggaccagatggagccgggcagcgccggctataacatgccgatggcgctggaggtgacggggccgctggaccaggtggccctggcgcacagcatcgacctgatcctggcccggcacgaagggctgcggacgctgtgtgtcgtgcgggatggcgagccgcgccagatcgtggtgccggagcgcaggggcgttctggagatccgggcggcagccgagccttcaagcctgcaggccctggccgaggccgaagcccgcaaagcctttgacctgacgcgggacatccccttccgcgccgccctggtgccggtcgggcccgagcggcatctgctgctgatcaccatgcaccatatcgcatccgacggctggtcgatgggggtgttcctggacgagctggcgcggttctatgccggctttgccgcgggccaggtgccggccccggcgcccctgccggtgcagatgccggatgtggctgcctggcagcggcagcgctatgccggcggccggctggaggcgctgaccggctggtggcgcgaccggctggcggggctgcccgatctggtgctgccgaccgaccggccgcggccgcccgtgcgcagcgatgccggcgggctgatcgcggtgccgctggaccctgcggccatggcccggctgcgggcgctggggcgggcggagcgggcgagcccattcatggtgctgctggcgatcttccgccacctgctgggccgctattcggggcaggaggatttcgcgatcggcacgccggtggcggcccggtcccggcccgaactggagccgctgatcggctttttcgccaacacgctggccatccgcagccgcataccttcagatgcaagcctgcgccgggcggtggcgatcgtgcgcgaggatgccggccaggccttcgcccgccaggacctgcccttcgaccggctggtggaagagctgggcatcgcccgcgaccccgggcgcaaccccgtgttccaggtgctgttcgtgctgcagaatgccggccgggcgaccccgcgggtggcggggctggagctgacgccgcttaaggcggataccgccaccgcgaagttcgacctgacgctgtcggtggtgccggggcccgtggcggagggggccgagaccgaggattacaaacaggcgttgttcgaattcgccaccgacctgttcgatccggccggaatcgagatgatgggagcatgtttcgccgaactggtcatgcgactttcggttgaagccgacgcgccgatgtcgtccattgcgctgactgccgcggggatggcggccgcagccgatgacgacggctggtgagggagggaggacgagatgacccgcgataccaccgacgccgacctgacggcccggctcgcagccctcgaccccgcccgtcgggcgctgctggaacggagcttggccgcccgccgggcgatgccgcccgcggatctggccggcgccgttgcgcggatgctggcaggcagccccgccgcccgggcgatggtctttaccctgcgggaactgggggtcggaaaaggcggggtcgtcggggtgcttttagccgaaacggctaagcacgggcccgaaatagccgcaatggctatttccgcggggctggccaccggcgccgatgtgctggtggcggcagatggcgatcggatgccgggcgacatgatcacgctgccctcggccgacctgccctggcccgaggtgccggcgaacaccccggcggttgcagcggaaccggttggacgggtgctgatcgacgggtcggatgggtaccagccggtcgatctggcggggcgcttcgcccggctggcggagatcttcgccggggcacgacgggtggcggtggaaagcgggaccgacgacccggatgccgtggcggcgctgatgcttgcggccgcaggcgggctgggcctgaccgggatcgaagcggcgaccacccggccacgggccatgctggcgcggctggccgcatcgccggcccaggccatggccatccggcccggatcgctggcccggctgatcgaggccgcaggcggcagcgaccatccgggcctggcgggcattgcggcgatcgatttcggcggggcggcggtgccggcggcgctggtggcgctggtggcgaagctgcagggccggcggctgttctgccattatgccgatggtagcggtgcgccgctggccggctgggagatcgacccggcgctggtgacgggagagaccgcaccggcggggcggcccctggccaagggccggatccggatcgtggacggcagcggcgccatggcgccggccggcatggtggggcggatcgagatccgcgctgccacggagggggataccgcagagggaggggccccctgggtggcgaccggcgatgccggacggcgcacgcgcgacgggctgctggaaaccctggcccggccggatggccggctgcgccgggacggccggctgctggacctggccgcggtggaacggcggatcgcccgcctgccgggggtggcggatgcgcatctgcgcctgcgccgcacggaagccggcccggttctgctggccgccctggtgccggccggtgcgcccgagcgggcggcggccgccctggccgccctgcccggctggtgccggcccgaggcggtgcagctggtcgaccatctgccgctgaccgccgcgggcgagatcgatacggcggcgctggaccagctgccggtgcccgacgaggccctgctggaggcggcggacgccgccctggcccccgcccccgcgatgaaggacccggacgcggtggacctggcgcggctggcggtgctgccgcccgcaccggaccggcgcgcgccgccgcccgaaaccctggtcgccaccggcgcgccgctgcccaggccgcgctttcgcaccctgcccgagattctggaccatgcggcagaccatgcggccgcacgcgggatcgggatcatccgcgacggccgcggtacgatggagcagatcgaccatgccggcttccgcgaccgggtgcggcttctggcgggcgggctggcccgcgccgggatcggccggggcgaccggctgctgctggtagtggcggagatcgccgactatctgaccggtttctgggcggcccaatggctgggtgccgtgccggtgccggtgtcggtggcaggcagctggaccatagaggacggcaatgccgccaagctgctgcagacccgccggctgctgggccatccgccggtgctggccgatcgcggccgcgccggcctgattgccgatttcctggcggcccacgaggacgacatgtcggcggggccggtgctggacccggcgctgctggccgaaggcggcgccatcgaagaggcggtggcggcggacccggatgcgccggcaatcctgctgctgacctcgggctcgacaggtgcgcccaaggcggtggtgcagacccatcgcacgctgatcgcccggaccaccgcgaccatcgcccatcgcgactatggcccgcaggatctgtcgttcaactggatgccgctggaccatgtgggcgcggtggtgatgttccatctgcgcgatctggccgcaggggccgggcagatccatgcgccgatcgatctggttctggccgagccgctgaactggctgcgctggatgagccgcgaccgggtgacggtgagctgggcgccgaatttcgccttcggcctgatcgtcgccgaggcggcgcggccgggggcgctggacgggatcgacctgtcggcgctgcgcatcctgatcaatgccggcgaggcgatcgtgccgcgcaccgcccggcgcttcatcaccgccctggccccgcacgggctggggcctgcggtgatgaagcccgaatggggcatgtcggaaacctgctctgccgtgatctgttccgacggcttcaccctggagggcaccacggatgacgacatggccgccgatctgggcggccccgtgcccggcaccgccttccggatcgtggaggcgagcggcatgctgccggtggggcggctgcaggtgaaggggccgacggtgaccccgggctatctggaaaaccccgaggccaatgccgaagcctttaccgcggacggctggttcgacaccggcgatctgggcacgatgaccggaggccggctgaagatcaccggccgggccaaggacgcgatcatcgtgaacggccgcaatctgcacgcccacgagatcgaggcggtggcggaagaggtgccgggcgtggcggtatcgtggacgaccgccttcgccaaccgcccggccggggccgataccgaccggctggtggtgacctgggttcccgaagaaccggtgatcgatcgcgaaaccgtggccggcgcgatccgcgcccgcatcgcccgccggctgggggtgaccccggcggcagtggtggcggtgcggcgcgaagacgtgcccaagacggcgatcggcaagatccagcgcgcccgtgtccgcgccgattacgaggccggccgcttcggcgggctggtggcggcccccgccgccggcgcgcccgaccagggcgttgttgacctgccgctggcccggccggtctggcggccggcggccctgcgccggcccgatccggcgacgcgggcggtgatccaccagtcagacggcggagatgccgtggcggcgatcgcggccctgcgcgaccggctggcgccgctgctgactgagggcagcggccgattgcgggtggtgctgggggtgcgcgggctggaggcgatcgaccccggcgacccgacgcccgaaccggccacggcggcgctggccgcctgggcggcgagcctggcgcaggaaaccgcgcggctggaactgagggtggtggatctggacccgggcgccgatgccgcggccagagaggcggagctggccgaagaggccgggcatgccgaccccgaaccggtggtggcccggcgcggcagccggcggctggcccgccgtctggaaccgctggacatggacctgcctgcaccccgggtgctgccgatcacggcgggcggcatctggctgctggccggcgggaccggcgggctgggggtggaactggcggagctgctgggccggcgcttcggggcgcggctgctgctggtctcgcgcagcgatgccacggcggacccgatgaaggcggcgcggctggcgcggctgagcgcggccggggtggagcatctggcgatgaccgcggatgtaaccgaccgcgcagcgctggacgcggccattcatgcggcccggagccattggggcgcgccgctggccggtattgtgcagatggcgaccgacggggcgctggacgcacaatgggcggagatggccgatcgcggcgggctggccgacagtgatgcggcgctggcggcgaccatcggcccgaaactggagggcacccgcaatctggtcgcgatcgcgcgcgaccatggcgacctgccgctgatcggcttcggcacggtgaacgcgctgttcggcgcgccgacgctgggcgcctattcggccgccaatgccgccatggcggcggtgctggccggcgaacgcagccgccgccaggccatcgcaacggcggcaaccgggccggtgacgaccatcgactggtcgatgtgggacgggctgggcctggcccagggtgccccggaacccgcccgcgcccgcacccgggcgctgggctaccggatcatcggccgcagccagggcctgcgggcgctgctggcggcgctggcgctggaccggccgcgggtggtggcgggtgtggatgccggcagccacccggtgatgcggcggccgcgtgcggcaccgccgcggccgctgctggtgccggtgacccggggaagcgtcatcaacgccaccgaccgtttcggccggcgggtgacgatcggcaccggggccgccgccccggccgggccgggcccggttgccgacccgccgcgcgggccggtcgagacccggatcgcggcgctgtggtgcgagctgctggaacggccggcgatcggccggcacgagaactttttcgagatcggcggccattcgctgctgctggcccggctgcgcgcccggatggtgccgcttgccgggcgcgagatcggcatcgttgaactgttccgccaccccaccatccgcgacctggcccgcctggttgccgcagacaccgccgagatcgaggccggggaatgaccgtcgacaccgccgacaccgcgcagagcttccccgtccacaccgtgccgatcgccgtgaccggccttgcctgccgcgcaatcggcgtggacggccccgatgccctgcgccgggtgctgctggaagggcgcgacgtgctggcgcgccatgatgccgccgatgccgcggccctgggcgtgcccgccgccctggcgcgggatccgcgctatgtcggcaccgcagcgatgctgccggggcaggagagcttcgaccacgcgctgttcggcctgtcgctgcgcgaggcggagctgctggacccccagcaccggctgttcctggaactctgccgcgaggcgctggaagatgccgcctggcttgccccggcggccgggcgccgggtaggcgtgttcggcggctgcggcagcccgatctatctgatgacccggctggccggtgccggtgcggcgctggaagcggcgggtgcgacggcgctgagctttgcggccaagccggatttcctgtcgctgcgcgtggcctatcggctggatctgcgcgggccggcgatgaccgtgcagaccggctgttcgaccggcatgagcgtggtgcaggcggccgtggccgccctggcggccggcgaatgcgaggccgcactggccggcgccgcctgcctgacccggctggacccggccggctatctgcaccatccgggcgcgatcgaaagcccgaccggccgctgccggcccttcgacgctgcggccgacggcacggtcggcggcagcggcggcgcggtggtggtgctgaagcggctggccgatgcggaacgcgatggcgaccatgtccatgcggtgatccgggcggtggcgatcaccaatgacggcggcgccaagatcggcttcaccgcgccgggggaagcggcccaggccgaggcggtcgcacgcgcattccgtgcgtctggcattcaccccgatacgattggttgcgtggaagcccatggcaccgccacggcgctgggcgacccgatcgaggtggcggcgctgacccgcggcttccgggccgccggcggcacgcgcctggcccatgcggcgctgggatcggtgaagggcaatcttggccatgccgatgcggcggccggcatgctgtcgatcgccaaggcggtgctgtcggtggcccatggcgagatctaccccaccgccaacaccaccagggcgaaccccgaattgcggctggccgaaaccccgttccgcctgccgaccgcacccgaagcctggcccgtcgccgaccatccccggcggatggcggtgaactgctatggcatgggcggcaccaatctgcacgccattctggaacaggccccggccaggaacccgcgcgcggcagcgcccgcgggcccgctggtcttcgtgctgtcggccgcagatgcggagatgctggaggcgctggcggcccggatggccgcggccttcagggccgatgatgcgccggccgccctggatgccgccttttcgctggccaccggccgaccggccctggcggcaaggcgggcggtggtggcgcgggatgtggccgaggccgcgcggctgctgaccatgcctgcccctgccctgccggtgctgcgcgaccggccggtcgtgatcgacggcgccgatgccggctgggcggcgctgctgcccgatctgaccgacagccccgatgcccgcgggctggtcgacggggtggcgccggcgcggttggtcttcgggccggacaatgcgccggggggcgatccggcagatccgctgatcgtggatggccgcgaccggatgcaggcgctggcgcggctgtggtgcctgggggtgcgggtcgactggacggcggtgtttgcaggcaccagcccgcggcgggtgccgctgccggtgatgccctatcgcccgacccgctgctggatcgacctggcaccggcggagcccgcgaccgctgcggccgcggcgccggtggctttgacacccggtttcgtcgaggccccgcttgccgccgggacggcgatgcccgcaaccatcgtcaccggatgtgccgcgccgacgaccggccttggaaccaccctgccgctggccgaggccggtgcagtgaccgggcgggtgctgctggtgctgcccggggcgctgggcctggccggacgccggccggccgaccccgaggaactgcggcaggccagggccttgcatgaccggcccggcgtggagctgacgatcatcgacacggccgcggccgtggatctgccgccggccgccgcggccgccctcgcggcccgcatccgcgccgaggcggcgggcgatgccccggcggtcgccttcgacggcgcccgccggctggtgccggtggccgaagcggtggccgccgacgaggcggcgccgctgacggatgacggctggccggcaccggaaacagcagggccggagaccgcaggaccggagctggccgaacccgcagcttcggccgccgcggcccggcttgccgccctgccggtggaaccggcgcgcgggccggcgctggaggcggcattggaccggctgtgcgccgcgcacagcgttgccatgctgcgcacaagggggatcgccccggtgcccggcgccaccatcacccgggccgagctggaccggcggatcgggctggtgcagggacagggacagttgggacaggggcagggatggcgccgcatgctggacgcggccctggccgatctggcggcggacgggctgctgaccattgccggcgaccggctgatctgggggccggcggtggccgatctgccggcgccggatgtggcggcagaccgggtgcgggcgatcgaccccgatcatgccgggctggtggcgctgatcaaccattgcatggcggcccatggcgaggtcttcgccggccggcgcccggccaccacggtgattgcggggcgcgaggccgggcggctgtttgcgggcgccggcccggcgatcgagcgccattccagccgggcccgggtgctggatgccgcggccgatgcggtggtggcggcggtggatgccgcagccgccgccggacgcacggcccggatcgtggaggtgggcggcggcacgggggccttcaccggcccggtgctggaccggctggccggccgggcggtcgactatcttttcaccgatgtgtcgggcgaattcgtggcgcgggcgcgggcgacgctggccgcacgcgggctgaccggggtgcgggtggcacggttcgacgtgtcgcgcgacccggcggatcaggggctggagacggggggcgccgatctggtgctggcgctggacgtgatccacgccaccgccgatctggccgtctctctcgacaatgtcgcgcggctgctgcggccgggcgggctgctgctgctggccgaactggtcatcgcccggcgctgggtgaacgcgatctggggccttgccaccggctggtgggtgatggcggatgaccgcaccacctctccgctgatcgatccggccgcctggcagcgggtgctggaaggcgcgggcttcgcgaccgaggcggtgctgcccgataccgacggcgccgatacccgcctgttcatcgcccgcaacacccgcacgaccctggctgagctggcgctgtacgagggcgagttgccagagcccctgccccccgccatgcgacatgtgctgatacgcccggccgcggcgggtgatctggtcgccgccgccctggccggggccgaggcgcgggcgctggaatgggcgaccggcgccgaagcagtggcctggaccggcgacggccggcccgatgcccggctgcgcggcctgctgcggcatacgcgggccgcggtgctgatgccgcctgccgccgccgatgcggcgggggcggcagcggcggcggcggtggatggcgatgcggccttcgccctggtggcggggctgtggcacgacctgctgggggtgatgcccgaggatgctgccgccgatttctacgccgccggcggcgacagcctgatcgccacgcgcctgctggcgctgctggccgaacgccacgggctggagttgccggcctctgcgctgtttgcggcaaccacggcgggcgagatggccgggctgatccgtgccgcggccccggcggcggcggaaccggccgcgatggagagcgatgccgacctgctggacctgctggccgatatcgagagcatgtcggatgacgagatcgccgccgccatggcccggctggaggggcaggaaccggatgggcgggaggtcgccgaatgaccgcggatatctccgcccggctggaccggctgagcccggcgcagcgtgcgctgttcgaacgcatgcgcggcaagcgcccggaccctgccgctgcgcctgaaacagcgcccgacaccgcgccagaggcggcgccgctgtccttcgcgcaggcacggctgtggttcctggaccggttgcagccggggagcccggcctacaacatcgcctctgccgtcgagatccgcggagagatcgacccggcggcgctggatgcggcgcttcagcaggtgatcgcccgccatggcgtgctgcggacgcggtatgaggagggggcggatggcccccggcagatcgtggacccggccccgcccggcccggtgctgcggctggccgatgcgccggatgccgcggcggcggcggccctggccacggcggaggcgcgccggcccttcgatctggccacggggccggttttccggctgctgctgatccggacggcacccgcccggcatgtgctggcggtgacggtgcaccatatcgccgccgatgcctggtcgctgggcattctgttcgacgagctgatggccgcctatcgcgcccggctggacgggctgccggcggatctgccggtgctgaccacctcttacgccgcctatgccgcggaacagcgcgcggcgctggatgcggcggccgaggcccggctgctggactggtggcgccaccggctggacgggctgccggtgctggactggccggcgggcccgccccggccgccagtccagcgtttcgagggcgcggcccggcgcttcgacgtgccggcggcgctgaccgcggccgtggaggcgctgggccggcaccatggcgcgtcgacctttcagaccctgatggcggcggcgcaggttctgatccatcacgagaccggccagcgcgatttcgccctgggcgcgccggtcgccaaccggcggcggcgcgagcacgaggcgctgatcgggtttttcgtcaacaccctgcccttccgggccaggttcgacgacgaccccgccttcaccacctggctggaacggctgcgcgacgatgcgcgcgcggtgctggcccatcaggatctgccgttcgagaaactggtcgaggcgctggaagacacccgcgaccccagccgcaacccgctggtgcaggtggtgctggccttccagaacgcgccggtcggcagcggtaccgcccccggcgggttgagcctgcgcgggctggagaccgatcagggcatcgcccgcttcgacctggagatccatctgacccgcgcccccggcggcgggctggcgggcatgatcctgtacgacaccgcgctgttcgatgcggcgcgggtcgaccggctggggcggcgcttcgtgcggctgctggagatggtggcggccgatcccggacagcggatcggcgatctggtgccgctgctggacgaggatctggcggcgatcgcggccgccgcccccgcggtgccgccggcggcggaactggtgccggtgcggctggcgcgcatggtggcggcgcgggcggcggcgccggccgtggaggatccgggcggcggcatcgactatgccgggctggatgcggccgcggcccggctgatgcaggcactggcgcgttcggggatcggccggggcgatgtggtggcggtgatcctgtccccggggcgggccgccgctgcggcggcaatgggcatctgggcggcgggtgccgcctatctgccgctggacccgcgccacccgccggcacggctggcggcgctgatccgccgcgccggcgcgcgggcggtggtggcgccggccctgcccgaaggggtggagctgctgccgcggctggatgtcgacgtcggcccggataacggcggtttcggcaatggcggggcggcggcgcgggcggcccggatcaacacggcggaggatgccgcctatctgatcttcacctccggctcgacgggcgagcccaagggggtggtggtgccgcatggcgcgctggcggggctggtcgactggcatgtgaatgccttcggcacggggccggccacccgggcgagcctggtggccggccccggtttcgacgccgcggtctgggaaatctggccggtactggccgcgggcggcaccgcggtcgcggcggatcccgccatgctggccgatccggcggcgctggccggctggctggtcgaccggcggatcacccaggccttcatgcccaccccgctggtcggcgggctgctgggccgggcctggccggcggagaccgcactccgcctgatgctggcggggggcgagcggctgacggaccggccgccccagggcctgcccttccggctggtcaacaattacgggccgaccgaggcggcggtggtcgcgagttcagggacggtgtctccggggccggcggcgagtatcgggctgcccgatatcggcggggcgatcaccggggcgcggctgcatgtgctgaatgcggccagccggccggtcggcatcgacatgccgggtgaactgcatgtcggcgggcgcgggctggcccggggctatgccggcgatccggtgcgcacggcgctggccttccggcccgatgccacgggcgatggcgtacggctgtatgcgaccggcgatctggtggtgctgcgggccgatggccggctggattttctgggccgggccgacgaccaggtgaaactgcgcggccaccggatcgagcccgcagagattgcggccgcgatccgcgcgctggacggcgtgcaggatgcggcggtgatcctgcgcgaggacggcgccgagccccggctctgcgcctacgtggtgtcgacggccgcaccggcgcggctggcccgccggctgcgcgaccggctgccgggctatatggtgccggcggactgggtgcagctggaccggctgccgctgacgacatcgggcaagctggaccggcgggcgctgccggcgcccgagatggcggcggcgaccggggcggtggcggaaaccgcggccgaacggctgatcgccggcatctgggccgaggtgctgggccggaagctgccgcccggccgcgacgatgatttcttcgccctgggcggccattccctggcggcggcacgggtggcggcgcggctgcaggcggcggggcggccgttgccgctggcaacgctcttccgcgccaccacactggcggcgctggcggcggagctggaggcggcggccgcgccggaggatgacgacagcatcgatctgccggacttcgcgccggtcgtcgacggcgaggtgccgctcagccccggccaggcgcggtggtggttcctggaccggctgggtgccgacccggccgccgcggtgatctcggcggcgctggatctgacggggccgctggatgtggaccggctggcggcggccttcgggcagatcgtcgcccggcatctgccgctccgcaccgccatcctggcggtggacgagcagccgcgggcagtgccgcagccggtgcccatgccctggccgctgccggtgctgccggtcgcggacgaggctgaggcaaacctgctggcacgggacctggcggcccggcccttcgatctggcgtcggggccgttcctccgcacgcatttgttgcggtttggcgctgagagacatctttttgattgtggttctgcaccatgtcgcggccgatggctggtcgatgggggtgctgatccgcgagctgcaggatctttatgccgggcgggcgccggcgccgctttcggtggattatcccgcaaccgcgcggcgggctgccgcgctgaccggccgggatctcgccttctggcgggatcgtctggacgggctgccgccgccgcaagcggtgccggggcggccggaaaacctgcctgacgccgccgatccggtcgtggtggtgcccctccccgaggccgcgagccgggggctggacgcgctggcacgccgggcgggggtgacgccgttcatgacgctgctgacggcggcacagatcctgttcgcgcggctgtggggcacgcgcgatttcgcgctgggcacgccggtcgccaaccggccggatccggcttcggaagccctgatcggctttctggtcaacacggtggtgctgcgcagttcgctggcgcaagccgaggacagcctggaccggctgctggcgcgggtaaaggccgataccatcgcggcgctggcccatcaggccctgcccttcgaccggctggtcgaggcgctggatgtcacgcgcagcggcaccgacaacccgctgttccgggtgctggtcgcctggcagccgggggatctggcgacacccgatctggcggggctggaggtgacgccccggccctcgcccctgatcggcacgcggctggatctggagatccacggccaggccgggccgggcggctggcatctggcactgacctacgccccggcacggctggcgcgcgcggatgccacggccatcggcacccggctggcgcgggtgctgacggcgatggcggcagagccggaccagcgctggacggcgctgccgatcctgggcgacgacgaagcggcgcggatcgatgcggcggcacgcgggcgcgcgatgacccatccgcgggtgctggacgagatcctggcgcgggcggcggaagaccctgccgccccggcgctgatcgacggccggagcagcatcaaccgccacagcctgaccgggcgggcggcggcgctggcgcagcagatttgcaaggcgcatggccgatccgtggggttgatgctcgggcgcggtcaggcgcatgggatggggctgctgggggtgtggctcgccggggcggcggcgatgccgctggatcccgatctgccggatgcgcggctgaagaccatgatcgagatcggccggccggcggcgatcatcgccgatccggcgcagctggcgcggctgcgcgcgctgaccgatctgccggtgacggtgctgcccgagggcgaggccggccccccgccggtgacggtcggacccgacgatcccgcctatctgctgttcacctcgggctctaccggcacgcccaagggggtgatggtggcctggcggacgctggaccaactgaccggctggcatcgcgcgcggcatcctgtgccggcgccgacgctgggctttgcacccctgggcttcgacgtgtcgatgcaggaggcggcgctcgcctgggccgaaggcagcccgctggtggttaccgacgagacggtccggcgcgatccggcggcgctgatcgctttcatccgcgcgcatcaggtcgcgcggctgttcctgccggtggtgatgctgcatgcgctggccgatcatctggccgcccatcccgagcggatcccgacctcggttgcgctgatcgcgacggcgggggagcagctgcggatcaccggcccggtgcgcgactggtgccggcagagccggttcgcgatcgacaaccagtacgggccgaccgaaacccacgtcgtggcggcggagctgctgccggccgacgccgtcgacgactggcccgaccggccggcgatcggccggccggtggatggcgcggtgctgttcgtgaccgacccggacggccgggttctgcccgacgaggtggcgggcgagctgctgatcggcggcacggccccggcgatcggctatgccggcgatccgctgcgcacggccgagcgcttcgtgaccggccccgacggcagcctggtctatcgcaccggcgaccgggtggtccgcggccgggacgggcggctgacctatctgggccgggccgacgaccaggtgaagatccgcggcttccgggtggagccgggcgagatcgaggcggcgctgggcgcccatgacgatgtcgcccaggtgctggtgacggtgcgccacatcgccggcgccgcgacgctggtcgcccatgtcgaacccagggtgatgccggccgacccggccggtctcgcgggccggctggcggcctggctgcaaacccggctgccggcaccgatggtgccggcgcgctgggtgatcagcccggccctgccccgatcggccaatggcaagctggaccgcaaggccctgccggcggtggacggcatccccccggggcagagcgtcggtgcggcaccggcgacggaaaccgagacggcgctggccaggatctggaccgcgatcctgggcgtggagaccgtgtcgcgcggcgacgacttcttcgcactcggcggccattcgctgcgcgcgacccagctggtcgcccgcatcgaacgggagctgggcatccgggtgcagctggcgacggtgttcgaacagccgacccttcagggcctggccgcggcggtggacgaggcgcgcaccgacgcgctcgccgacgatctggcgcttctggacgacgacgagcttgccgccctgctgggtgatgacgatctgagcgcccttctgggcgacgacgacctgagcgcccttgcgggcgacgacgatccggagaccgccgcatgaccgacgccccccgcccctcggccgaggcgctgcgcgcgaaactgaaaacgctctcgcccgaacagcgcgcggcgctggaacgcaggctggcggcagccaaggcgggggccgctgccaccggcacggcaatcccgcgcattccgcgcgaccccgcgccggcggcatccttcgcgcaggaacggctgtggttcatcgaccggctggcaccgggcactgcggcctacaacctgcccgccgtgctgcggctggcgggcgcgctggaccaccgggcgctggaagacgccatcgggcggatcgtcgcccggcacgaggcgctgcgcaccgcgctggtcgaacgcgacggccggccggtgcagctgatcgccccgccgccggctgcctggccgatcgcggtcgaggatctgagcgactgcccggcggagatggtgacggcacgggtcgccgccgaggcagagacgcccttcgatctggcccagccgttcaagctgcgcagccggctgctgaaactggccgccgacgaccatctgctgctgatcaccctgcatcatgtggcatccgacggctggtcgctgggggtgctgaccgccgaaatcggcacgcattacgcggcggcacgcgcgggccgcgaaaccgacctgccgccgctggcctgccagtatgccgatttcgccgcctggcagcgggggcggctgagcggggcggcgcttgagcgcgagatcgaccactggcgccgcaccctcgacggcttcgtgcccggcgagttcccgaccgaccggccgcggccggccgagcagcgcttcgagggcgcggtggtcagccgccggctgccggcggcgctggctgcgaaggtcgatgccgcggcgcggcggcacaaggcgacgcccttcatcattctgctcgccgccttcaacgccctgctcgcccgctggtcgggcgaggtggatgtatcggtcggcatcccggtcgccaaccgcacccatcccgatctggaggcgctgatcgggtttttcgtgaatgcgctggtggtgcgggtgccgctggacggcgacccgaccatggacgagatcatcacccgcagccgggcggcggccaccaccgcctatgaccatcaggacctgccctttgaacggctggtggcggagctggcgcccgagcgcgacccgtcgcggccgccgctgttccggatcgcctttgcggtgcaaaacgcgccccggggcagcgtcaccctggccgggctggaactgcgccccttcacggccgaaatcacccgcacccgcatggagatggagtggcatgtcttcgagcgccgcgacgagaccggcgccgcggcggggctggacctggtcgtcgcccatgcgaccgcgctgtttggccgggcgacggtcgaacggctgatcgacggctttgcggtgctgctggaagcggggctcgaccggccggagacgcggctgtcggccctgccggtgatgacggcggccatggaaagggcggtgatgaccgcgggccgcgggccggcccctgaggccatccccgcccccgacctcagccgggtgctggcagaacggctcgccaccgaccgggtggttgtggccgaggccggcggcccgcggctgaccggccaccagttgcaggcgcgggtggagcggatggcggcggcgctggccgcgcgcgggctcgcccccgaaaccccggtgctgctgctgatggatcgcggcatcgaccagatcaccgccaccctcgccatctggcgggcggggctctgccagatgccggtcgatccggcccagcccgatgcgcggctggcggcgatgatcgccggcggtgccccggggcttgcgatcagcgatcctgacggcctggcacggctctccaccctcgcccccgatttgccccgctgcgggccggcggaccttaatgccgagccgcggccgctgccggcggtgcatggcgaccagctcgcctggatgatcttcacctccggctcgaccggcacacccaaggcgacgctggtgacccatggcggcgcgctcaacaccggtttcgcccaggcgcggatgctggggctggggacggaagaccgggtggcgcaactcgcctcgcccggcttcgatgccgccctttcggaactgctgatggcgctgatcgccggggcggaactgatgccggtgccggcggcggtggcgcgcgacccgctggcgctgggcgatttcctggcggccgaacgggtgacggtggcgacgctgaccccgaccatgctggcggcgatcggccgggatctgcccgatctggcggtgctgctggtcgccggcgaggcctgcccgcccgaactggtccgccgcttcgcccccggacggcggatggtgaatgcctatggcccgaccgaatgcgcggtctgcgccaccatggcggtcgggctggacgcagaggcgggcccgccgccgatcggctccgcgatcgacggcgcggaacttctgatcctggacccgcgcggccggccggtgccggatggcgttgcgggcgaactctgcatcggcggggcaggcgtcggccgcggctatgccgggcgggcggacctcaccgccgaacgcttcgtgccccaccccgcccccgaccggcccggcgcccggctctatcgcagcggcgatctggtccgccgccggccggatggcgcgctcgactatctgggccggatcgacacccagatcaaactcggcggcaaccggatcgaacccggcgagatcgaggcggtgctgcgcgccgacccggatgtggccgatgcggtggtggatgtgatcgagatggagaggccggttgcggccgcgcccgcggatgcgggcagcggcccggcgatcgcgctccgccccgccgacgccctggccgatggccggcggctggaactctggccctcgatcgccgagcatttcgtctatgacgagacgctctaccacgccatgacccatgacgaggcccgcaacgcccattaccgggcggcgatccgcgccgcggtgccgggcaaggtggtcgtggatatcggcaccggcgccgatgccatcctggcccggctatgcgtcgaggcgggcgccgcgaaggtctatgcggtggagctgctgaaagcctcggccgacgccgcgcgcgcgaccgtgcggcggctggggctcgacgaccggatcatcgtcgtcgaaggcgatgcccggcgggtgaccctgcccgagcccgcagacatctgcgtgtcggaaatcatcggcccgatcggcggctgcgaaggctctgccgtcatcctgaacgatgtctggcggctgctgaagcccggggcggagatgatcccggcgcgcacggtgtcgatggtggcggggctggaactgccggccggtttccgcgaggcgccgggcttttccagcctgaccgccggctatgtgcggcggatcttcgaggatcgcggcgggcccttcgacctcaggctctgcctgaagggcatcggccccgatgatctgctgaccgatgccgccgtgttcgaggatctggaccatgccgggccggttgcgaccgaaagccggcatcatgtggtgctgaccacccgccgcgccggccatctgtcggggctgaccgtctggctgaaactggaagccgcgcgcggccgggtgatggacacgctgggcgagatctgctgctggctgccggtcttcctgccggtcttcggcgagggccggcccgtggccgcgggcagccgcatcgccatgaccatcacccgcaccctgcatgccaacggcatcaacccggatttccggctgaccggcacgatcgagatgcccgacggcaccagcgagcccttcgactggttctcgcccaatcatggtgccgaagcgggcttccgcgcctcgcccttctatcgccggatcttccccgaaacggcagtgcccgacctgcccaccccgaccgcgtctcccgccaccgatcgccggctggtcgcctgggtcacgccgcgcggcggggccgaccccgagggcgatgcggcgctggcccgcgaccgggtggaggaatggcgggcactctacgagaccgcagggccggccgcggcagagacggcagcagatccgacgccggagacggaccccggagacgccctcttcgccggctggaacagcagctataccggccggccgatcccggtcgacgagatgcgcgactggcgcgaccggacggtggcggcgatccgccgcgccctgccggcggggcgcccggcccatatcgccgagatcggctgcggtgccgggctgctgctggaaccgctggcgccggctgccgcctcgatcctcggcaccgatttctcggccgcgacgctcgccgggctggaaacccggctggcgggccatggctggggccatgtccggctggaacgccaggaagccgccgacccgctgccgatcgaccgcccggtcgatctggtggtgatgaattcggtggcgcagtatttcccggcgcccgcccatctggaaaaggtgctgctgcggatcggcgcggccctggccgggggcggtgccgccttcctgggcgatatccgcgatcacgggctggcggagatcttccatgcctcggttctggcctttcagtccggcggcgccctgcccgaccgcgacagcgtggcccgggcggtggcggcggatgaagagctgatgctggacccggcctggttccacggcctgatcggccgcatcccgggcctcgcccatgtcgaaaccctgatcaagcgtggccggggcgacaacgagctggtgcgctatcgctatgacgtgatggcggtgttcggcccggcccccgcggccatccggcccgaggccacgctgccctggccgggtgccgaagcgctggccgcgcgactcgccggcctgaccggcgcgctggaagtgaccgacatccccgatgcgcggatcgccgacgacaccgcccgcgggcagcggctggggctggtgtctgcaactgctacgggtgaacccgcccatcctgacagcctgcacgagatgggcgaaaggctgggccgggcggtgcggctggcgccggcggcctccggcatcgcaggcgcgatggatgcgctgttcgatgtgccgggcctcgccgacgacccgctggcccggggctggatgcgcagccccgtgtcgcggggccggttggcaaacgatcccttggcgcgccgccgcaagtccgccctcgccgaccggctgcgccgccgggcgcgtgaggtgctgccggcggcgatggtgccgcaggcggtgatggtgctggaccggctgccactcggcgcgtcgggcaagctcgaccgggcgcggctgccgcggcccgagacggcggccggccgccatccggcgcgcgatcccgcccgcgccctgccggccgaccggctggaagcggcactcctggcgctgtgggaagagctgctcggcaccgcgccgatcggggtggaggatgatttcttcgccctgggcggccattccctgctgggggtgcggctggtggccgaggtgaaggcgcggctgggcggcacggtgccgctggacctgctgatgcgcgcgggcagcgtgcgggcgatggccgtgcatcttaaggaggccggcgacctggcggacgacggcgagctggcggacgacggcgccgggacgggccgcctggtgccgctccgccgcgacggcagcggcgccccgctcttctgcctgccgccgggtggcggcacggtgttctgctacggcccgctggtcgaccggctggccccaggccgcccggtctggggcctgcaggcggcaggcgtcgagccgggcgagaccccgcatgaaagcctggaggagatggcggccgcctatctggcggcgatccgccgcatacaaccgaaaggaccgtatcacctgatcggctggtccttcggcgggcatgtcgcctatcagatggcggcgatgctggaggcggcgggtgaagaggtcgcgctgctggccctgctcgacaccttcccgcccgaacatgtgccgcgggtggatgaacgctaccggcgcgaggaagcctatctcgcctatctggccgggctggccgggcttgcggtcgcagaagacgagctggcaccgctcacctcgccggcgcgcctccgcctggtggcggaccgcgcggtcgcggccggcgccctgcccgcccgcgacgccgagggcacggtgcgccgcctgctggccctgacccagatctcgggccgcctggcgcgcgaggcgaccctgcccgcctatggcggcccgctcgccatgctgcgcgcggccgaggccctgaccccggccctggaagatctggcccgccgcgacccggcctgcggctggggccgccacgccaccggccggcttgccaccgcaaccgtgccgggccgccacgacacgatgatgaccgccccccatgtcgaccgcctggcaaccgtgattgaccatctgctgacgcagactgtcaccgagacggcggcagggtaagatcagaccagaccaaccaccagaagacaccccccgggggggaccggatacaggagacgcaggatgagctgggacgacgaagaagaccgcacgatctatgaagtggtcgtgaaccacgaggaacagtattcgatctggcccgccgaccgcgacctgccgctcggctggaacaaggccggcaaacagggcccgaaggccgaatgcctggagtatatcaaagaggtctggacggatatgcggccgcttagtctgcggaagaagatggaggagcaggcgcgggaggcgggggagaggtgaggttttgggaatttttatttcatcttcacaatatttctccaatattaaatcacaacagcagtaaattatctatatatctctaaaatcgccgcttatttaaaatatacagaatcagggaggagggatatgccacatatttatcaacttgctcttcttggagtaccaactgatgcgcaggtttccgagattgaagaggtcatcggaaaggctgtgggcatgtttaatttacgattggggcatgatgtcggatgggaggttcgtcccgaagagttcaacccagatcagcaacgttcgtctgctgcggtatttttcggcggtgagaacccacctcttgccaacgtagcaaagcttctgaaacgaggcatccctttgctgccggtggccaccgatgtcacccgaatcggtgcagaaatcccgaccttactgcagccgctcaactgcttggcgtacagcgctggcgggccgcaacgtgtcgcaagtgctctgctagagtgtgccgggttacttcctcggcagcgccgggtattcgtaagctatcgtcggggcgaagctagggaggctgccttacagttgttcgatgcactgtctgctcggctcttcgatgtgtttctcgatacacatggaattccgcctgcagaagatttccagacaatgctgtggcaccggctttgcgactcggatgtcctactcatgctcgacacgcctagctactttgaaagccgctggacgagcgcagagttcggacgcgcgctggcgaaaggtattagcgtcttacgggttggttggccagactgcacgccatctgcgcgaacagccacagccagtcgcgcagagttattgcccgaagaagtggatgcggccacaggacgcctcgcagacagcgctgtggagcgaatctgtcttcagcttgaagaagttcgcagtcaaagccatgcggtccgttccgtcaatctagtgagcaatttgcgtaacgcaattcaaacgattggcggacaacttgtcggagttggacctaacaaggcggtctacatccagctaccgaatggccggaatgtcgttgtctacccgacggttggcgtgcccacgtcaacatcgttgcatgacgcatccaccaattcgccggatcagtcggttgccgtcgtttacgatcatgttggcttgcatcctcggtggctggggcatttggactggctgggccagcatatccactccgcacggtgggtcaaagccagcgaggctgggtggcaatttgcagactgggaggcctgaatcgtgagcgcaatcttcctttcagccagtgtcccacttgtcggccgcggctcgtatcacgagaccgccaatccatttctcatccagtgcgctgtgagggagctggtcatagccgtcatccgtcagcacaagatcgtgtggggaggccatcccgctatcacgcccatgatttggagcatctgcgaggatttgggggttgattattgtggcgccgtgattctgtatcaaagcacgttcttcaaggatcgctacccggaagaaaacgaccgctttcacaatgtggtcttcaccaacgcagttgccggtgacagagatgcgagcctgctgctaatgcgggaagagatgctatcgcgcgatgatctcgttgccgctgttttcatcggcggcatggaaggagtggaagccgagcatgaactcttcaggcaatttcatccggccgccaaagtcctgcccgtgccgtcgccaggcggggcggccttgaacttggccaaagatcaaggccatttcactgatgaggatcttgttgatgtggactttgcgcgactttttcacacgcacctcgcatcgaacattcaaggcgcagcgggctgaatctcctctaccgatttgcacgggccaacaaaggattcgccatggcacggaaagtcttctatagctttcactatcaacgcgacggttggcgcgcctccaagatacggaatattggtgttgtggagggcaacccgccagcaagcgataacaagtgggaagaggtgaagcggggcggcaaggccgcaatcaagcgctggattgacaatcaactgcaagggcggacatgcacgattgttctggtcggcgccgaaacggcgaatcgcccgtggattcggtatgaaattgagcagtcatggaatactggaaaggggctcttggggatacgagtccacaaactggtggaccacaaccagcaaccatcagttgccgggggcaatccgttcgactcatttaccttgaacgacggtagaaagctatccaccgtcgtccgcatctacgatccaccaggggccaccagcagcgcggcctacaaccacatcagtgacaacttgtcgggttggattgaagcggcgatcgctgctcggtaagaccgccaagcctctcgtcagaacaatgacccggtgctcatggggcgcccatagagctccgagatttgcttctggaactgcgtctgccccccgtagctaggatgcctcacgcaaaccacgggtacagaatctgtgatgcgatgggccgcagcggcagcatcgttgccgatggcgacgatgcgagaggggcgcagcaagacaatgagctgttggagcagatcttcgccagctcgcctctcacgcgcgttgtgctgccggttggtgaaaggatctcctgattcatgcgggtggagagggaagacgttccaaaggaagatgcgagcatcaatgtgctccagcatgccccatatgaccgcggcggttcgttcggccacggcactgcctatcgtcggacgctcggcgacctggtcgagatcccaacgcctagcgtgctggcttatgtgaacgtcgtcggtcagagctaacccagtgcggcgccctccgcgatatccgaggtctcgtccgatccatatggcgtctacgggttcctcggttgcacgacgcaacatggcggacagtgcggcagcacggcgacgcggtgcgtcgcgtcgatcatgaacttcacaacgatccgagtatggattgaagcagtcttcgaactgcagtgaagcaactgcatcaacaaatggatgggtcttcatttttcagactccaatggcatgtatgtgatggcacgttgttcgcggtctccaataatccatccaccttgatttaatttgagctggcgaaatacagcataaccatccaggatggccttctcccagagtttcaacggacatttctctacttcgtaaccgctcacgaactcgccaattgtcttgagaattccaagtgaaaccttttcctgttcctcaaagaaattcaactctttggccctggaaaaaatccaggccgtaagtccttcctcaacgacgatggcccggccgctgtcctgctcttcatcgtatttcggattgctctttcgcttgtgcttgattaatgcccgtatcaccggcgaccaatgcaagatggctgcataggcaaaatggaagacatcatggaaccggtagccatcgcgatcggcaatgttgtcagtcagtggctctccaatgaatacacctttccattggagataactcttgccactgccccgctgattaacccgaattttgaagtccctgggtagctgttcctcaattccaaactcactgtcaaaatcaagcccggccaagtcatccgcttggggctccagaaacgcaccgcgagctttccggagattaccacgagccacctccgaaaacgctagttcggccgcatggatcgcatccagataggcccgtgcgaagacaaccagatcagtgcgtgcaggtgtgcttcccagtagggccgccgctgactgccccaagcgtaccaacgtggcatccaacgaagcagtcgcggcgacaggcacagcgatataagccaacgcacctccggtgatgtcacttgcagcgcccacattcttgaagtttccgtggttcgcagcttccgcgaagatctcttcaagaggaatctgcacgcgcctgcagattgcggccaaataccagagggcgtcgccaaactcttcttctgccgccttcctgaaacccgggtaagaagttctctctcgtacacttttcttagccgtggtcattattccgccgacttctccgtatagaccttggaggacagggtcgaagtcatgcggattaagtacgtctgttgcggcaatttccgccgcatagtccgagagcaagagggagccttcttttttcatcggtcacccgcgaagagtcagccattcgaatggagcaccctgataaccactcacgtcaaagctgcgaatccattgctcaagattcgcaatcagctgcgcatcatcaaaggtggtcagacctcttcctcttttgcatagaggccgattctgcttgtctttcagttcctcgggaaacttcggcccctcgcccccgaaatacagaaagtcactgctaatcagaaccctgttaacgcccgtgtcgcgggcgacatggtctgaattgagtgtgccgtcggggcgggagtgaaatgagtctcgctgctgccaagcggctccaggcgcggccctgaagtagatactatccccgcaactttgcttccggctcccattgcggtacggctttttagcctcgaaccgtgggtctgcgccatactcgtcaaatgtcatcgcctcagtcacgcgcatcgcatacacgagatgcccgccacgtcggacagttctatcattgctcccactgccgaccacccaatcgccgatgtcagcggatctgcggatactgggtttgcaggtcgcaagcgtgcagtagccgtagaagggattaggtgcgaaaccactgtcatatcgcaccacataggagtgaatgcgagccatcagcaggggtgccgcttgagtggaaccgggtcgcaggcgccaccgtcaggcttctcccacgagtccttcccgttgatcgcatcaatgatcgcatcgccgttccacccaaccaaagcgtcagcatattctttcagagcctctgggaggtcgcattccttctcgccatgctcccaaacaccaacaatgcgcttgccctgtttggccgcatattcgatttcccagttcacccagtcactgtccttggtctggggggaaacgtagcaaatgaacactccagcccatttgatggcaggggcaaggatctgtgtctttatatagctctcattggtagcattgttaaatttccccgtatggatagaggaatccctgatctccatccctttcggagccagcaaatcctttagcttctggagtccatgatcgtccttgtggacatggctaataaacacattcctttttcctgtcattcaacccctccagctttacatcgatggtcaaatgcgaatagtgagaatcctacaatcaacatgcgatggaaaacctgtcgctcttatcaattatcagatcaaaattattcaggacgcaatacagagaatgagcggcgtgacgggttggagggaagaaggggggcagactgtttggtggggtccagaccgtttagttaggcaacggttcattgcgacaaaacaggtagcggtataatcgcccagcaatctcaccccctcctcccccaaaccccaaaaaacaccacccaaaacaccaccgccgcgacaatcgccgtcgccaccagcgcccagctcatgcccaccggttcggccaggcgccagatcggttctgccggggtgacttcggggttctggacgatggagaacagcgacaggttgttggcgaggtggacgccgatcgccggttccaggcgctgggccttgaccgtcagcgcggccgcgaacaggccggcgatgaacaggctggcataggtttcgggcgtgttggcggggctgtaatggtagagggagaagatcagcgcggcgccgatggcggcgaccaccgggcggccgatcacggcgtagacgccctggaggggataggcgcggaagaccagttcgtcggaggtcgcctggatcaggtagagcacgaggccaagggccaggcccgcgatccagcctgccggttcgaacacgaagttgaaggtcaccggctggccggcgagccagatgccggcgagcgaggacagcgtcaccaggggcagatagatcaggaaggcgaggccgaccagcttcagatcataggtgcgcgtcggcgagatcagggtcatgaacggccgctggttgagcagccggacaaccaggaagacgcccaggatccagatcgggaacatcgccatccagatcaggaagcccacgatgttggccgtggtcgcgaacagattgaccatggcgtcaggggggccgtaggtattgattgcccaggcctggatcgggccgatcacctgggccgcgcccagcggcaccaccaggaagatgatgatcagcccgatgccgtagatcagctcgctgctgcggccgaggcggcccatgtcgagataggcattgctgcgggcggccgggccggggccgacggcagagccggttgcggttgcggcaggcctggccggtgcggtgctggtcttctcgctggcggtcatgggcaccccttcgtgatcaccccggccggctcccgatacccggcacgtgtcgggtgcccactctatcaccaacctgtggcgatctgcatcacggagtgcctatcgatgcgcaatcttttccgaaggttcacaacgtgcggtcgcgggcggcgatcaggccgttgaccagggcgaccaggccgatgccgctgagcagccaggcgaccagcgaccagccgccggtgagctcgtggatcaggccgatggcgagcggcccgagtgccgcaagcgtgtagcccaccgactgggccatgccggaaagccgggccgccgtcatcgcatcgcccgaccgcagcacgatcatcaccagcgccagcgcgaaacagccgccctggccgatgcccagcaccaccgcccagggccacatggtcgcaaccggcccccacatcatgccgagcatgcctgaaatcgtgcagaccatgatcgccagaacccagagctgctgattgcgccgccgggcagccagcacgggcacgaacagcgccgagatcgtctgcaccagcagcgacaccgacaccaccagccccgacatcaccacgctgacgccacgatcctgcagaatgctgggcagccagccgaacaccgaataggcgagcgagctttgcaggcccatgaacagcgtgatcgaccaggccagcggcgaggtcagaagccgcgtgccggtattgggccggtgccccgcccgggtgtccagatgccgcgccgccggccaccagaccgcggcggcgagcagcgccgggatcgcccagacgcccagcgccaccgcccagctgccgctggcctcggcaatcggcgcggtgaccccggcggcgatcgcggcaccgccgcagagcgccatggtgtagataccggtcaacaacccggctttgtctggaaacgcctgtttcacgacccccggcagcaggaccccggcaatgccgatgccggcgccgcccagcagcgagccggcgaacaggccggtgggcccgaagaagccacgcagcaccacgcccaccgcgatcatcaccagcgccaccaccgcggcggccggcacgccgatgcggcgggcgagcatgggggctgccgggccgaacaggcccaggcacatcaccggcagggtggtgaccaggctggcggtggcgctgtcgaggccgagcgcggcggagacggtgccgagcagcggcccgatgctggtgagcgccgggcgcaggttcagcgccaccagcacgatggcgacgatcagcaacagcgcggcgccgcggctgacggcggcagaggatcgcggggacgaggtggacatggtcacagaccgggggctttcagtgtgcggaggggcttggtacgggaggctttcgggggcgaagacgggtcggacaaccggccttcgaccaccgccatcagcggggccaggaggtcgcgtgccgcctgtgccgcccggtcgggatcacgcgccgcgatggcatcgcgcaccgcgacatgggcagcgaggctcggctcgggcaggctccgatcggcgagcgagatgcgcagatagcggcgcagctgattggtgaaccagccatagagttcggcgagcgccgcattgccggcggcctcggccaccgacaggtggaaggcgatgtcctgttccagataggtctcgaaggcggcgggatcacttggcgccggctcgaccagaccgcgggcggccagggcgcggtcgatgcgggccaggctgtcgggtgttacacgcaaggcggccagccgtgcagcctctacctccagagccgcgcgcagctccagatgatcgcgcagcccggcattggcgacccggcgcagggcgtcggccggctcgtcgaccgcccggacataggtgccgtcgccctggcggacctccagcaggcccagataggcgagcgcccgcacggcctcgcgcaccgtgccgcggccgacacccagggcctgggccagttcgggttccggcggaatcctgtcccctgccccccagccatcccggccgatctgggcacgcaaccgctcgatcgcggcatcgacgagactgcgccgggcgacggcgccgaggctggacatggcgggcaggctccgctgacatcggttcagccgatcatccgatgttttgggccgggatgcgagcgggaatgggggcgaaaatgggcggcccgacaggccgccctcaggcgcgccgccgccggatctcggagcggaggagagacaccgcacccgccgccgacatcagggcgagcgtgaaccaggtgagcgcatagaccagatggctgtcggggaagctgactttggtgagcccgcccacgggatagccgccgggggcggtttccgcggcatcgacgaagtagggtgccacctccgccaacccgcgggcccgggcgatcgctgccacgtcgcgggaataccaggcctccgccgccgggtcgttctcgcgcaggaagccgccgccgggttcggtgatccgcatcaggccggtgaccctggtgtcggtgtcgatctggccggcggcacggctggcggggtctttccgatcgggcgggacgaagccgcgattgaccagcacggtgaagccgcgatcgtcggcgaagggcgtcaccacccaatagccggcgccgagatcggtggtggcgcggaccagggtctcgcggtcgttcaggaagcggccggaaagcgccacgcggcgatattcgtcaccgtcgcgggtgatccgggaccaggcatcaggacccggggccgcgaccggatcctgatggatgcgggcatcgacgcgcgcgatcagatcatgcttccaggcccggcgctccacctgccagatgccgagcgccagcccgccggcaatgccaatgagaaagaggacgcccaccagaatgagcgtccccgtcctgcggccgcgccgcccgccgggaggagcccccttttcgggacgccccccttccggcgtgatgtcgcctttcggcttggtcacggcagctggctcatgtcgtggaccggcatcatgttggtgttcagatggtacatgacccacatggacccggcgagggtgatcgccacgatgatgacggtgaaggtgagggacagcatgttccagccgccctcggaactgacgttcatgtgcaggaagtagaccatgtggaccacgatctgcacggccgcgaaggccatgatcaccacggccgtggtctgggcgtcttcgatcacgccgcccatcaccagccagaaggggatcgccgtcaggatgacggagaggatgaaccccttcatatagccgctgaaagaggcgtggcccgcgccgtgatcgtcttcgtgggcgtgcccgtgggcgccgtgggcctgggcaccatgcccgtggacgttggcgccgtgcaggctgttcagctccgcgctcatcgcagcatccccatcagatagacgaaggtgaagacgccgatccagacgacgtcgaggaagtgccagaacatgctgaggcacatcaggcggcggcggttggccggaaccaggccgcgcttcgagacctggaccatcagcgtgaccagccagatggtgccgaaggtaacgtgcaggccatgggtgccgaccagggtgaagaaggccgacaggaaggcgctgcgctgcggcgtggcaccgatatggatcagatgcgcgaactcgtaaagttcgatcgagaggaaggcgaggccgaagagccccgtgattcccagccacatctgggtctcggccaccttgcgcttctccatcgagatcatggcgaagccgtaggtgatggacgagagcagcagcatggtggtgttgagcgccaccagctccaggtcgaacaggtcgcggggcgccggcccggcggcataattgccaccgagcacggcatagaccgcgaagagcgccgcgaagatcaggcagtcgctcatcaggtagatccagaagccgagatacgtgctgctgccttcggcgtgcgcgtgctcttcttccaggtagaacgggcgggcctttgcggcccggcccgaggccggacgacccgaagcggagggggcgccgtgaacggttgcagtcatgtcgtcacccctgaaccgcgagctggcgggtccgctcggcttccgtcttctccacggtttcgaccgggatgtggaagtcgcggttgtagttgaaggtgtgatagatcgccgagccgatcagcgccacgaaggacaccgccgccagccaccagatgtaccagatgagcgccacgccgagcacgacgctgagccccgccaggatgatgccggcgccggtattcttgggcatgtggatcgagcggaagcccatctgcggacgctgatagccgttctgcttcatgtcccaccaggcatcacgatcgtagatgaccggggtgaaggcgaagttgtagtccggcggcggcgacgaggtcgcccattccagcgtgcgcgcatcccaagggtcgccggtggtgtcgcgcagcttgttgcggttgcggacactgaccgcgatctggatcaggaaggcggcgatgccgccggcgatcatcaccgcacccagggcggcgatcacgaaccagatctgcagcgacgggtcgtcgaagacccgcatgcggcgggtgacgcccatcaggcccagcacgtagagcggcatgaaggcgaagtagaagcccaccacccacagccagaacgagaccttgccccagaagacgtcgagcttgaagccgaaggtcttcgggaaccagtaggcgatcgcggcgaaggcgccgaacagcacgccgccgatgatgacgttatggaagtgagcgatcaggaacaggctgttgtgcagcgagaaatccgccggcggcaccgccagcagcacgccggtcatgccaccgatcacgaaggtcagcatgaaggcgaccgtccacatcatcggcagctcgaagcggatgcggccgtgatacatggtgaacagccagttgaacatcttcgcgcccgtcgggatcgagatgatcatggtggtgatgccgaagaaggcattcacgctggcgcccgagcccatcgtgaagaagtgatgcagccagacgatgtaggagaggacggtgatggcgacggtcgcatagaccatcgacttgtagccgaacaggcgcttgccgcagaaggtcgcggtgacttccgagaacacgccgaacatcggcaggatcaggatgtagacctcggggtggccccagatccagatgaggttgacgtacatcatcgggttgccgccgaagtcgttcgtgaagaaattggtccccacgtaacggtcgagcgacagcagagccagaacggcggtcaggatcgggaaggcggcgacgatcaggacgttggtgcagagcgaggtccaggtgaagaccggcatcttcatcatggtcatgccgggcgcgcgcatcttcacgatggtgcagatcaggttcacgcccgacagcaatgtgccgacgcccgcgatctgcaaagcccagatgtaatagtcgacgccgacattcgggctgtaggcgatgttcgacagcggcggataggcgagccagccggtctgggcgaattcacccacgaacagcgacatcatgatcaggaccgcgccgccggtggtcatccagaagctgaaattgttcaggaacgggaacgacacgtcgcgggcgccgatctgcagcggcacgatgtagttcatgagacccgtgacgatgggcatcgccacgaagaagatcatgatcacgccgtgggccgtgaagacctggtcgtaatgatgggcgttgagatagccttcgctgccgttgaaggcgatggcctgctggaggcgcatcatgatcgcgtcggcaaagccacgcagcagcatgatgatgcccagcaccatgtacatgatgccgatgcgcttgtggtccaccgtggtgaaccactccttccagaggtagccccacaaccggtagcgggtgaggacggcgaagagggcgaggccgccgagggcgaccgcgatgaacgttccaaccacgatcggctcgtggagcggcagcgagtccaggctcagccggccgaggaggaacgacgtccctgcggtttgttcagacatgattaccggagtctcaggtcaggaattggcggggccgggcacgccggtctcgggggccggggtcagcaacgacaccgccttcggggccggactcacgtcctggttgttcttggcgttgatgaccggcgtctgggcggcagcgccgccggcacgaacgccgatcgggtcgtcggtggtgcagagcgcggccacatagaccggctcggggccgaacaccgcaccgcggcgaccggtcttgtcgtattcgagcgaggccaccgggatgacgttgttgatgcccgcgatgccgaggccgccgcggtcgtcgatcgccatcatctcccccatacacatcttgcccggctcgacgcacatgttgaggatgcggtcatagagcttggggtcggcatgggcgaagtgcatgaccggcacgttctcgctcggccgctccagggtcagataggtcggcccgtcgagcgtctggcccgaggcgcgcacggtggaaacccagcccgcgaactcgtcctgcgacaggccgtggaacttgaagcgcatgcccgagaagccggcgccgctgtaattggccgagaagccgtcgaaagtgcccggcttgttgatcaccgcgtgcagcttggtctgcatgcccggcatggcgtagatctggcccgccagcgccggcacgaagaacgagttcatcaccgacgaggccgtgatcctgaaggtgatcggccggtcgaccggcgccgccatctcgttgacgctggcgatgccgtattccggatagatgaacagccacttccagtcgagcgcgaccacctcgacctccagcggcgtcacatcggcggcgaccggctggtcggggccgatacgatcgagcggcttgtaggggtcgagcgcgtgggtgctgatccaggtcaccgtgcccaggcacaggatgatcaccagcggcgcgccccagaccgccagctcgatcttcgtggaatggctccactccggctcgtagcgggcgttcttgttggactgccggtatcgccaggcgaacaaaacggtcagaagcatgaccggcacgatcaccagcaacatcagcacggtcgacagaaggatgaggtccctctgctgcgacgcaatgtcaccagacggattgatcaggacgagattacaaccgcccaacaacgccatgagaggcagggtggacaggacgcggatccggctcaagacagtactcatgggatagggtgtcacttttgtgcggcgcaacaacggaccattgcggcgcgcatcataggactcgcccctgccgaaggcaaaagcgaaggtcggccatcctgaccaacctctggtctcatggcctgctgtgcggcctgaaacctatatggttcccaagactctgcagggggtatgaatgcagtgcgacatattggcgcatcgcggatgcgaaggccctccggcggcgtctgcgtctcttatggataagttatttatcgcagaatgaaatttgagtgcgggtaccgccccgcatatccgcagaccgcacgggcgcgccccggcatgcggcgacaggcggacttgaccggcggcgggcgccaccctttcgccgggggctgcgggcgggttgggcgggatatggtcaaccggcaggagggtgatgggtcatcggacgggtcggtgtgttcgctattcaaatgttgatggcccgtggtcctggggtataaatatctaaaatcgaccacagaacatcagaaattcaccccatgattgcaggatctctactaggacaaattgcagctgtatcgattgatcgtcagtgtctcccggagaccatgtatgtcgctggatgatctgttcggagcagcactgacggcggcacggcaaggcgtcgtcggcctagaacaccgatgcaagccgaagagtttacgacagctggacaaaaacacagtcggattcctcaagatctatacccgatcgattgcggagagggtcagatctggagatgtcctcgcggcagatgtttacctgctctggctggtcgatgaagcgggaaagatatggctggcgttcgaagaggcgtttgacgaagacgacgagatgttccgctttgtgctgaaccgtgaaacgctgggtggtagcatgcataagttgccgaaaccgctggcaaaacttggacatccgtctctggtcggcgggggcaaggcacgtatcgggggcgaactgatctttgatccggatgcgacgcctcccatatggtatttgaacaacaagtctggtcgctatggtctccgggctgatcggacggtggcacatctgcagaatgtgcagaagctgttccgcgaccacgggctggagttccaaatcgacttccggccttcgggacaatcttgaggatgggccgatgccgggcgaagcaagcatgctgacacctgaagacgtcgtgaacaggctggcacgcctgagctttgcccgcctgcgccccagcgaacgccgcaagctcgccgaggccctggatacccccgaactgagggggcaggtgttcgatcgcttcggggcgttcctgcgcggcctgccgctggagacggccgacgggcaggatgagttgctggtggccgtcgcagatctgaacatgaccggtttctgggatcgcctgcccaagcgtgtcatccacgactggcagcgcttcggcgtcgaccgcgaacggcttcaatgtctggccagtctggttcggggatatgacggcgctgccgcagagagaatcgagcatgccctgaagccgcgggttcagcgcgcagatgaagcccgaccggatccggccatccgccaggtcatttattgagacatcagcctcgactgccggcgcccggcgccttccaccacatcaccccctaggcacacccgcgtctcgcgaccataatggcgccgggatcacgccccccgcgcttgggataggggggtgaaactgtgcgatgcagacgggaggggcggcggttcatggccaggaagccgatcgaggtcaccacgctgaagcatgatgcagcaacccggcggaacattccgaccgcggagctggaagcggtgatgaccgacggcgacaaggctccgctggccgtcgcctatgcgcggcgcaaccccgatctggacccgcagctgatctggcgcggcaaggaggcgccgggaacggccgacgcaggggcagaggcggcaacgctgaacgtcgcggcccccccgctctatattcaggagaaggtccacccccaggtcctgatcgaggatctgcgccgtgaaaccgaggcccgcgcagccgaggcccgggcggcggaggccggcgacacgcccgacctgttcgccgacttcaacggcctgcccgatggcgaggcggtgaccgagttctacgcccacgaccagcactggtcgaaccgcatgatcctgggcgattcgctttccgtgatggcaagcctggccgaacgcgaggggctgcgcggccaggtgcagtgcatctatttcgacccgccctatggcatcaagttcaacagcaatttccagtggtccaccaccacccgcgacgtgaaggacggcgatcgcggccatgtgacccgcgaacccgaacaggtccgcgccttccgcgacacctggcgcgacggcatccattcctacctctcttatatccgcgaccgcctgacggtggcccgcgacctgctcagcgagagcggcagcatcttcgtgcagatcggagatgagaatgtccatcgggtgcgggcggtgatggatgaggtaatgggcccagagaactacattacgagcattcttattcagaagacgggaagtcaatatggagaatttatccagaataattttgattatatactatggtattcaaaatcaaaagattctgcagcgggaaaatatcgacctctatttgaagaaagacaaggaaaatcttctagagaagtcagtattttccgcaaggactataacgcaaatccgttgacttcagacggctatcgagacaccaccacagttgatttttacttcgagggaggagtgttccatccaggaagactcgcgcactggaaggttaccaatgagtcccttgaaagagtcggaaaggcgggtagaattattaggcaaaaaagccaaattcgtcttaaatatttttatgatgattttccggtaactaggctaggtgtaatttggagtgacgtggggggagcctctggcaaggtctatgttgttcaaacttctcctaaaatcgtcgaacgctgcctcctgatggccaccgaccccggcgatctcgtcctcgaccccacctgcgggtcgggcaccacggcctatgtggccgagcaatgggggcggcggtggatcacgattgatacttcgcgggtgtcgctggccctggcgcggtcgcggatcatgggggcgcgctacccgtattatctgctggcggattccgaagagggccggcgcaaggaggcggaggtgacgcagagcgtgccgcgctccggcccggtcgggggtgatatccgccagggcttcgtgtatgagcgggtgccgcacatcacgctgaaatccatcgccaacaacccccggatcgacgagatctgggaagactggcaggcgcggctggagccgctgcgcgcggcgctgaacaccgcgctggggaaatcggacaaggccggcacggcctgggaggagtggcagatcccgcgggaggccggccgcgactggccggaggccgccagccgcgcccatgccgcctggtgggaggggcgcatcgcccggcagcgcgagatcgatgccgcgatcgccgcgcgcgccgacagcgaattcctgtatgaccgcccctatatcgaccgcggcaaggtccgcgtcgccggcccgttcacggtggagaccctgtcgccgcaccgcacgctggcggtcgattgggacgacgagctgatcgacacgctgaaggccgcggaaacccggcgcgcgggcgggaccggcgggccggtggtgccggatttcgccgccatgatcctggacaatctgcgcgccgccggcgtgcagcaggcgcataaggaagaccggatcagcttcaccagcctgaccggctggccgggcgaccatatctgtgccgaaggccggttcttcgaaggggcggacgacaccggccgcgaacgccgggcgggcattctggtcggcccggaattcggcacggtgtcgcgcgccgatctggtggccgcggcgcgagaagcgggcgatgccggtttcgacctgctgatcgcctgcgccttcaactacgatgcccatgcggccgaactggacaggctgggccgggtgcaggtgctgcgcgcgcgcatgaaccccgatctgcatatgagcgccgatctgaaaaccaccggcagcggcaatctgttcgtgattttcggggagcccgatatccgcatcgagcccgcggacgaggccggtgccgacatgatccgggtgcgcatccagggcgtggacgtgttcaagccccagagcggcgaggtgatttcggaaggccccgagggcatcgccctctggatgctcgacaccgcctataacgaggagagcttcttcgtccgccacgcctatttcctgggggcgaacgatccctacaaggcgctgcgcaccacgctgcgggccgagatcgaccaggatgcctgggacagcctgcattccgatatctcgcgccccttccccagacccgccaccggccggatcgcggtcaaggtgatcaatcatctcggcgacgaggtgatgaaggtgttccaggtcgactgaccggcggaggcagagcccgatgacccagtccttctttgaccggccgatcctgaattcaccctatctgatgcccgaccggcattgggaactggtcgacggccagcccaccgaccggatcatcccccggcgccgccggtccgatctggtgacgccggtgccgcagccgcagaagcggcgcagcatcgccagccaggcggcgctcgacctgggcggccgggcggccgatcgcggcgaggatcagatctataacccgaccccgatcatcaacgaagtccgcgcgctgatggaagactggcgccggctgcccaatcccaatgactggaaggtgacgccggaaaccgcccggctgctgaagcactggcggtcgcacaatttccagggcgtgcggccgttcttctgccagatcgaggcggtggaaaccgccatctggctgacggaagtggccccccatctgggcgagcgcagccggggcatcctggcgcatctgaaacaggccaatcgcgagtttaacggcgagctgttccgcatggcgctgaagctggccaccggcgccggcaagaccacggtgatggcgatgctgatcgcctggcagacggtgaatgcgctgcgccatcccggcagccgccggttcagccgcggctttctgatcgtcgcccccggcatcaccatccgcgaccggctgcgggtgctgctgcccaacgaccccgaaagctattacaagacccgcgaaatcgtgccccccgatctgctgccggcgatgaaccgggcgatcgtggtcatcaccaactatcacgccttcaagctgcgcgagaccctggagctttccaagggcaaccgcgccctgctggagggccgcaccgggccgaagctgtccaccctggaaaccgaaggccagatgatccagcgggtgatgccggaactggccgggctgcgcgacatcgtggtgctgaacgacgaagcccatcactgctaccggccgaagctcagcgatgccgagggcagcaccgaggcggatctgaagggcgacgagaagaagcaggcccaggacgacaacgagaccgcccggctctggttctcggggatcgaggcggtgcgccgccggctgggcctggccctgatctgcgacctgtcggccacgcccttcttcctggccggatcgggctatcgcgaaggtgcgctcttcccctggacgatgagcgatttctcgctgatggacgcgatcgaatgcggcatcgtcaagctgccgcgggtgccgatcgccgacaacatggcctcgggcgacatgccgatgttccgcaatctctgggaccatatcggcaaaaaaatgcccaagaagggcaagagccggtcgggtggcggcggctatgacccgctgagcctgccctcggaactccagaccgcgctggcggcactttacggccattacgagaaggtgttcgcgctctggcagcagcagggcatcggcgtgccgccggtgttcatcgtggtgtgcaacaacaccaccacatcggatctggtctaccgctatatctcggggttttatcgcgaggaagagacgaaccagggcgacgccgcgccccggagagaggatggcggtctcagcggtccgttcgaacagggccggctggcgctgttccgcaatttcgacgactacggcaaccccctgccccgccgcaacaccatcctgatcgacagcgcgcagctggaaagcggcgacgggttgagcgacgccttccgcgccgcggccgccgacgagatcgccgagttccgccgcgagatcgtggagcgcaccggcgaccagcgcgccgccgagagcatcgacgatgccaccctgctgcgcgaggtgatgaacaccgtcggcaagcgcggccggctgggggaacaggtgcgctgcgtggtctcggtgtcgatgctcaccgaaggctgggacgccaacaccgtgacccatattctgggcgtgcgggccttcggcacccagctgctctgtgaacaggtggtcgggcggggcctgcgccggcaatcctatgaactgaatgccgacgggctgttcgacgtggaatatgccgacatcctgggcattcccttcgacttcaccgccaaggcggtggtggcaccgccggccatcccgcgggaaacggtgcgggtgcgggcggtgcggccggaacgcgacccgctggagatcgtgttcccgcgggtcgaaggctatcgcgtcgatctgcccgatgaccggatcgatgcggagttcagcgccgattcggttctggaactcacccccgatctggtcggcccctcgatcgtcaaatgccgcggcatcgttggcgaagaggtcgacctgaccgtcgaacatctggacggcatgcgcccctcgacggtgatctatcacctgacccggcatatgctctatacccgcttccgcgaccctggcgaggcgccgaaactgcatctcttcggccagatgaagcgggtggtgcgccgctggatggagggctggctgcgctgtgcgggcggcaccaccccggcccagctgatctataccgagatcgccgacatggcggcggagcggatcatcgccgcgatcaaccgcgccattctgggccaggatggcctgcgggcccccggcggggggcggatccgtgcgatcctggacccgtacaacccctccggttccagccgtcacgtcaacttcaccacctccaagccgctgcgctggcagacatcgcccgatcactgccatgtcgacctggtgatctgcgacagcgaatgggaggccgaattctgccgggtggccgaagcccatccccaggtccgggcctatgtgaagaaccagggtctggggctggaggtgccctatctggacgccaacatcccccatcgctacctgccggatttcatcctgcgcatcgatgacggccggcccgacctgctgaacctgatcgtcgaaatcaagggcttccgcggccgcgacgcccggatcaaggccgagaccatgcacacccattgggtgccgggggtgaacaatctcggccagttcggccgctgggccttcgccgaattcaccgccgtctatgaaatcgaagcggcgtttgcacggctgatggaagaggtacggggacagatggctgcctgaacgggatgggcagaacaaggccgcccgtcaggcttcaagatccgccaggaattccgagcccggcgccacgcccgaaaccagcagccggtcgcgggcgcgggtgcaggcgacatagagcagatggcgttcggtgtcgtaaacatggtcgagatcggcttcgtcggcgatggcggcgatgcgggcggccgatggcagcgcgtcatcatcacaggccatcaccgcgaccgcgcggaattccagccccttggccacatgcatggtggcgatggcgatccggccgtcggccaccgcgacctcggcccccagatgggccggggccagaccaagtgcggccgccaccgcctcggcgcgtggccgcaggctgtcgtcgcggatgatcagggcgatttcctcgggcgacatgccgtcatccagcaggtcgagcacccaatcggtgatcaggcggatttctgtcgtctcgtcgacggcaagacggatctctggcggcgggccgtcgaacagtgagacggtgccgtcgcggccctcgctgacgccgtcgacatcggccaacacctccggcagcaggcggtcggcccgggtgcggatctgatgcgaggtacggtaattgaccttgagcacatgcgaccggccccggatgtcgatgccgagtgcggcccatgaaaagggctggcggaagatcctctggcccagatcaccggcgaagaagagtgcatcggggcgggatgcatcggggcgcccggaaccggagcgggcgaggctggccaggaagcgcagttcggccggcccgacatcctgcgcctcgtcgacgatcaccgcatcgaagcgcgcgtcatcggtgggcagcccttgcggcggtgtggccgggatgatcgcggtgtagatcgcggcaagcgtggtgaagccctgatcggccagatcggcgcgcaccgcatcgaccaccgcccagatctcgtcgcgctggcgggcgcccagccgggtgcggcgaccaagacgcggcgtggccctgtaggccgccgcatcggtcagggcgcgggcctcgatcacctcgtgccattcggcggtgatgaagccggggcggagatggcgtgggccggtcggccctgccgcccgggccaggatcgccgcccgcacggtttccgcatcggcgatccgcaccggcccgagccgcgcgcgtgcggcatcttccgccagatcgggcaaggcccgcacggtgatgcgggccgcaaggtcgctgtcatggccggtcagccgctccagcttgtgggccagggcggcggcgagcggtgccgaaacggtggtcagcagcacgcgtgcccgggcatcccggcgggcgatccaggccgcgcgatgcagggcgaccacggtcttgccggtgccggcagagccggcgatccgcaccgggccaccatggtcacgctccaccagccggcgctgatccggatgcaggaacacgatccagcgatcccaggggtagtccagcgcccggcgcagatcttccggggtgtggatggtgcggaaccggcgtccgtcatcgggatgttcgaaggccgcggtgccgccggcgtcgcgacggaccggcaggcggcccgtggagacatagtcgagcagcgcctcgaccgcctcctgcggcaggcgttcggccacatcgaagaaatcgggcgacgaggcgtgccgcacggcctgaagttccgaaggcggcacgccgatgccgagcatgtcgtcatcggtaagatccaggaaaagcggcggatgccatggctcctgggggacgtctgccgcctgccgcaatggaggcgcggtgccctcatcggggccggcgacttccggcagcaccacgatctgcgtggcaccggtcaccggatggcgttcgatgcgccgccgttcggcccagcgataggccgcatcgtgatggtcgacataggccagcagcagcgcatcatccagccggtgcagaatgatacggatgtcggcattcacccgcaccgaccagaaattccgatctgccgcccggtcgagccggtgcatccgcaaccccggcgccgcgggatcgagctgcagatcgaaagccgcggtcttggcggctttcagatccggcccacggagcctgcgcagcccgtcgacaaaactgtcggcgatgcggaaatccatggcgcccctccccctgccgatcctgcccccgtcttcgacgtataagccgcgggggcagatcgcgcaatggtagggcgttcagcagatgccgttgataatgtccagataccgccgcaccgtctcgtcccagccgtaatccagcgcctcggcggtgatggcgtggccgatggagacttccaggcagccaggcgcgcgcgacaggaagtcggcgaggttgaccaggttcaggtcatggccggcattgaggccgatttccgcctcggcggcggcgcgggcggtggcggccacataggcggcggcgggttcgaaatccgggcggtcccaggccatggcgtagatgccggtatacatctccacccggtcggcccccagcgccttcgccgcggccggggccttggggtcggggttgatgaacacggcgatgcgcgcgcccgagggccgcaccagatcgatgccgcgggcgagttcttcggcccggctgtcgaaatcccagccctcttccgaagtgcgcgcccccggcgcgtcggggaccagcgtcacctgatgcgggcggacctggttgaccagctcggcgaaatcttccgacgggtagccttcgatgttgaactcggcgccgatcacctcgggcaggtcggtcgcgaacagcccggccaggtccatcacatcgctgcgccggatatggcgctcatccggtcggggatggatggtgatgccgtgagcgccggcgcgcagcacccgcttcgccgtcgccagcacgtcgggatagccgttgtcgcgctgattgcggagcagcgccaccttgttgagattgacgctgagcttggtggtcatcggccgccgtcccctgtcgttcgcacatgcaccccatgccggtcacccgggcgaaaacacgccccgcctgccctggccgaaacgggccgggctggcggggcgggggacaggatatatccggaaggccggcgcctgcgaccgattgttcggcgaaatttcttcagcctgaaccgcagccgtcagcgcctgcccgcgcaggcatgatacgggtcacaccgccttcagcgccggcggttcgtcgggcgtgccgatctggtcgaaccgctcgaaggtgtggtcggcccaacgagcgacgtcgtagcggcgcacggtctcgtacatcgcggccatgcgcgcccgcgcctcgtcgggcgccatgtcgagcgcctggtcgagggcggcatccatcgcccggtccgaataggggttggtcaggatcgcctgcgggaattccaccgcgcagccggtgaattccgacagcaccagcgcgccctcctggccgcgcttggccgccacatattccttggcgaccaggttgaggccgtcacgcagcggcgtgatcacgcagacatcggcgcggcggtaataggcgatcagcttgtcgaaggggatagcgttcgagaacagcaggatcggcgtccagccaagggtcgagaagcggccgttgatccgcccgaccagggtttccacctcgcgctgggtgtcacgatagatccgcatgccggtggcggcctgaaccgacaccaccatcagcttgaccttggtgtgcagctccggccggcgttccagcaggcgttcgaagccctgcagggtctcgcggatgcccttggtatagtcggtgcggcccaccgccacgatcagccggcggtcacgaagttcctcctcgatttccgactgaagcgtctggttggcctcggtgtcgagcaccttggcgacgaaattcgggttggtgcccaccgggaaggcgtcgatgccgaccttgtggcccttgtggcgcaccgccaccggcacttcgggttccgacagcgccagacccgagggcgacatgccgtcttcgacccgcgtggtcgcctctacctccacatcacgcaacgcacgcgcgacatcggcgaagttcttggcgtagcgcggaatgtggaagccgaccagatcgcaggccagcaggctgtccacgatctcctcgcgccagggcaggatgttaaatacgtccggccccgggaaaggggtgtggtggaaaaaggcgatcttcaggctgggcttgatccggcgcagatagccgggcaccagccagagattgtagtcgtgcacccagaccagcgcatcatcctcggcctgggcggccgccgcctcggcgaacagccagttcacctcgcggaaggtgttccagtcggtggtgtcgtagcggaacagccaggggaaggaatgcaggatcggccacagcgcctctttcgaggtgacgtgatagaacatcctgacctggtcggcggtcagcggcagccgcgagaccgaataccggccatagctgtcctcgatatcgatcacccgctcgaagctttccttgcgctttgggctgacctgtttccaggccacccaggcgcccttgccttcgggcacgcggccgaaaaagctcttcagcgtcggaacgatcccgttcgggcttttgttttcacgatagacgacgcggtcgccgaccacctcttcctcatagggctgacggtgatagacgatcacgagcgatgacttgcggttcatccctgtccctttcgatctcggttgcggtcccggctgggggcgggcgggttctgccggtaccggcaggcacccgcgggctcagtcgaggccgaaatggcggatcgcctcggcgatgccggcggcaccgtggccggtgctccggtaaacccagggcttgtcggtcagctgctcaacgaggcgcggctcggaattgccgaccgccacccctttcagtccggtttcgaacagcgagaggtcgttcagcgtgtcgccggcgaccagaacccggtcggccggcaggttgagggtttcgaccagctgcagcagggtcggccccttggccacccccttgggcagcacgtccagaaaggtatcggccgagagcagccagtcgaaaccggcggccgcgatcttgtcgagggtggcggtttcaagctcggccggctcgtaccaatagctcacccgccgctcaaacggcgtgggctgcagccggatgccgggctcccccgacagcatggacttgacccgctcgcctgcatcgttccaggcccgggcaatcggcgcctgaacctggtcgaccacccggaaatcgcggccggcgaccacggtggtccccacatcgccgatcacgaaatcgggatgcggcatgccgggttcggcgaccagttcgcggatgaagcccagatcgcggccggtcacgaagatcagcagtgcgtcgttccgggcctgaagcgcctgatagagcgcgcgccgttcttcgtccgagcccccgaggaaggtgccatcgaggtcggttgcgagtatcagcttgtgttcggtcatcaggcgtccgtcgtctcgagatcgctcgcgcggctggcggggtggtcgatcgcgaccaccggctccagcgcgcggctttctgcccggatcgggcgggtgagcagggcggtcatcgcggcatcgatgtcgagccggccccggatgatggcgtgtaccgcttccgagatcggcatctcgacgcccagcctgcgggccagcgcggtgacggtctcggcattcacggccccttcgaccacggccgacttgccggccagcgcctcgtcgggcgtggcgccgcggcccagcgccaggccgaaggtgaagttgcgcgactgctcgctggagcaggtgagcgtcagatcgccgatgccggcaaggccggtgacggtctcgcgccggccgcccagcgcctgggccagccgcttcagctccgccagcccgcgggtgatgatcgcggcgcgcggattggagccgagcccccgcccggcggcgatgccgcaggcgatggcgagcacgttcttgaccgcgccgccgacttcgaccccggtcagatcgtcggagagatagggccggaaactggtggtccccaacgtcaccgccacccgcgccgccagcgaggcgaccagcgccgcccccatgctttcagggtcgagcggcccgtcctcgtcatcctccagcggctgaacatcggccgaggcgatggtgacggcggtgggctggccctcggccacctcggccgcgaagctggggccggaaagcaccgcctgggggcggccgggcatgacctcggcgatcacctgggtcatcaacaggccggtgtcgcgttcgatccccttgctgcagatcacgaccggcatgcccggtgcggcatggcgctccacctctgccgccatcgcccgcaggaattgcgaggggatgaccagcagggccagatcggcgccgtcgagcgcctgccccatgtcgccggtgacggaaatcccggccggcatgtcgtggtctggaagaaagggattgcggccgccggcgcggatcgccgccacggcctcggcttcgcggatccacagacgggtctcacgccccgcccgatccgccaccattgcgagcgcgctgccccaggcgccgccgccgatcaccgccacccgccggaacggggtgatgacgggcacgggctccggagcgctgctgctctcttcgatactcaccgcgatgatgctccctcgttgttgtcggtcgcgccgccccggcgcagcaggccgcaccgcggggcacgttggtcttaaatatatgctgcgctgcagcggaatgaagggtgtcccacggaaaaccgccaaaggacgcgtgaaacccacggatcaatgcgtatgatcatagcacgatgcgccagcgggtgcgacagcgaagggacgagcctatgcaatggtggcgaggtgcggtgatctatcaggtgtatccgcgcagcttccaggacacgaacggggatggtgtcggtgatcttccgggtgttaccaggcgattggggcacctggcggcattgggtgtagacgccgtctggatttcacccttcttcaagtccccgatggccgatttcggctatgacgtcgaaaactaccgggaagtcgacccgctattcggaacgctcgacgattttgatgtgatgctggcagaggcgcaccggctggggctcaaggtcgtggtcgacatggtgttgagccatacctcgcagcgccatcgctggtttcaggaaagccggcgcagccgcgaaaatgcccgcgccgactggtatgtctgggccgatccgcgccccgacggcacgccgcccaacaactggctgtcgatgttcggtggcagtgcctggacctgggaaccgcggcggcggcaatactatctgcacaacttcctggccgatcagccggatctgaacctgcacctgcccgcggtgcaggatgccctgctcgacgagtgccgcttctggctgaaccgcggcgtcgacggcttccggctggatgcctgcaactgcctgacccatgacctgcaattgcggaacaacccgccgcgccccgccgatatgccgcccaccgaggcggtgacgccgtccaatccatacaactaccagcggcatctttataataaatctcaacctgagaccctggggttcctcaggcgcctgcgcgcgctcaccgatgaatacggtgatattctgctgatcgcagagatcgccgacgacgacagcctgaaggtgatgcgcgactatgccggcccgaaggcgccgcttcataccgcctattccttcgccctgctcggcccggaattcgatccgcgccatgtgaccggtgcggtcgacgcctttcatgccgacggcatcgacggccggccggggcgcgacggctggcccagctgggcattcagcaaccatgatgtcgagcgggtggtctcgcgctggggcgggcgggatgcgccgccggaattcgccaaggccctgatcgcgctgctgtgttcgctgcgcggcacggtcttcctctatcagggcgaggaactgggcctgcccgaggcggacgtgccctatgaacagctgaaggatccttacgggctcaacttcttccccgatttcgccggccgcgacggctgccgcacgccgatgccgtgggaggatggcgaccgccatgccggcttttccaccgtcgacggctggctaccgatccccaacgaccatctgctgagggcggtggcggcccaggcggccgatccccaatcggtgctgtccttcacccgccatttcctgcgctggcgcaaggcacggcccgagcttgtgaccggcgacatcgacatcgtcgaggccaccgagcacatgatctgcctggtgcgcagcctgaacggccgccggctgatggtggcgatcgaactggccggccgcggcggatcggtggcactggcgggcgaggtggacgaggtggacgaggatcaccgcctggcgctgggctgggtggagggcgaccgcgtcaccctgccgccctatggtgcggttttcgcctggctgcgcgactgagcctgccccccacccccgaaacgggaaacgcgaaatggatgataaaattcccgggacctgccgctgcggcgcggtgaccttcgaggtcgaaggccggccgctgatcaccatggcctgccattgccatgaatgccagcacatgaccggcagcgccttttcgctgagcagtctttatctctccgaccgcttccgggtgacgacgggcacgccggtggcgcggcgggtggggcagatggccacccatcatttctgccccgactgcgccagctggctgttcacccgccccgacggcatggacgagctggtgaatgtccgtgccaccctgctggccgatgcggccggtttcagccccttcatggaaacctggaccgcggacaaactcccctgggccaccacccccgcggtgcacagttatccgggcttcccgccgatggaggcatacccggcccttctggccgaattcgccggaggcacgacggcacccggatcctgacgacaggggcggctcttcggggccgcctttttcatggcccctgcccttccctcacaaaactcgaattaattcgaatttaccggcttgagcgcccccaaatctcacgctaggctcttcttcagacagaatcgcatcgacttcagttcggggggagccggatgacgtcgacggtcgcagacgcgcccagacaacggcgcggaaggctgcgtttcgagagcattctcgacgcggcggaaagcgtgcttcagcagcggggcaccaccgaaatcagcctgcccgaagtggcggcggcggcaggtgtgccgccggcctctctctaccactactttcccaacacgcgggtgctgctgttcgagctggcccggcggtatatggagaagttcgaggttctggccgaagaggaggtcgatcacgaccggctcgcagcctggaccgatctgttccgcatccattgcgaccgggcgctcgatttctatcgcaaccatccggtggcgatgcggctgctgctcggacctgaaagcggctggcagatccgatcggccgacctgtccgccaaccggcagatcggcgagatccagtatgaccggctgctgcgccatttcgtggtgcccgacagcgacgaactggcccgcgccctgccagtctccatgaccatcggcgatgcgatctgggcgctgtctttcgcccgcgacggcgatgtgacgcccgagatggccgcggaatcgctccgcgcccgcatcgcctatctgcgcctctacattgccgagaacacgcccaagcgcgtccatcccctggggggttgagccatgactgatcagaacgagaccgggacgggccgcttcgccggcggcgccgcctgggtccgcggccgtttcgtgccgatggacgaggccgtcctgcccgtcaccgactggggcttcacccggtcggacgtggtctatgacgtggtccatgtccatgacggcgcctttttccgcctgcaggaccatctggaccgcttcgagcgggccatggcccgccgccggctgaagccggccgaggaccgggcggcgatcgaggcgatcctgcatcgctgtgtggcgctggcggggctgtcccatgcctatgtcgccatggcctgttcgcgcggccggccgcgggtcgcgggctcgcgccgtccggaagactgcgacaaccatctgatcgcctatgccatcccctggatcgacgtgatccccaaggacgtgcaggcccgcggcgcgcatctctggatcgccggcacgccgcgcgtgcccgacgcctcggtcgaccccacggtcaagaactatcagtggaacgacctgacctcgggcctgctggaagcccatgacgagggctatgacaccgcgatcctgttcgaccgcgacggcttcctgaccgaggggccgggcttcaacgtcttcatcgtgtcgggcgaccgggtgctgacccccgatcggggcgcgctccagggcatcacccgcaagacggtgctcgagctgtgcgacgggctgggcctggaaggccgggtggcgccgatcacgcgcgagatgctggacgaggccgacgaggtcttcaccaccaccaccgccggtggggtgatgccggtctcgcgcgtcggcggccggatcctgggcaatgaccggccgggccccgtgaccatgcggctctacgatgcctattgggcggcccatgccgatccgcgctatgccacaccggtgctgccgctggaggccaccgccgggctggaggccgcctgatgagcgagacggcaaccggttccggatcggcacggggcgaccgccccggcggggatctgcgcgcgcaaccgttttcggggccacgcaacggcgctcgcgaactctgggcggaacgccccgagccggacggaccggcagccgcctggtgctattccgaccggcggagctaccggccgggagaaacggtgcggctgcacctgtcgtcgaccttgaaagcggtgcgcctgcgcatcctgcgcgagggggcgtcgccacggctcgcggccgaaatggggccgctggaaaccaggttccatgcggtgcctgaacgggcctgggagaccggctgcggctggccggtggcccatgactggaccatccctgccgatctggcccccggcggctatctgatcgaaatccgcgacgcggccgacccggacgccctgccgctcggccatcatctggtggtgatccgcaatcccgcgcccgcgggcggcatcgccctggtcgcggccaccggcacctggtcggcctataacgactggggcggcgccaatcactattacggcatggaccccgaacgtccgcgcggccgatcccccatcctctcgacccagagaccctgggcgcgcggccagatctggctgcccgaaggggcgccgcgctcggtcaacgccgtccgtccacgcggccctggtccggcgcgctatgactgcgtggaatgggccttcctgcatggattcaccaaatactacgccctcgccggctgggcttcctatgaacggcccttcctgatctgggcggaacaggccggctatcgggtcgaggtgctgacccaggaagatatccacgccgatccggcagcgctggatggctatgactgcgcggtcttcgtgggccatgacgaatactggtcggccgaaatgcgcgacacggtggacggctatgtcgcgggcggcggcagggtggcgcgcttcgccggcaatttcctctggcagatccggctggaggacgatctccgccgccaggtttcgtacaaatacgatgcccgcggccatgatccgatccggctgtcgggcgacaccacccgcctcaccagcgcctgggaagacccgctggtcggccggccgggggcggaaaccttcggcgtgaacgcactccgcggcatctatgcggccttcggcggcatggcgcggcgggcaccgcgcggcttcaccgtgttccggccggaacactgggccttcgccggcacggggctctgctatgccgacatgttcggcgatgaggccaatatcttcggcttcgaaatggacgggctggactacaccttcaccgacggcctgccggaaccgaccttcaccgacggcgcgcccgaaggccttcagatcctggccatgggctgggcgaccctggccgaaggcggacggcccgaggacggctggtcactgatgctgggcgatgccgacgcccgcttccgcgccgcgctgctgaccgacgatgcgtcggaggaaagcctccgcaaacatgcccgcggcagcggcatggtggtgcatttcaccaaaggcgccggcgaggtgttcaccgccggcacctgcgaatgggtcaacgggctgatcacccgcgatccctataccgagcgggtgacgcgcaacgtgctggaccggttttgtggggggcaggtgcacggaagttgattgcactcccaatcttcaagccgtactgcaggggcccttatcctgcgtactttccgaggcccgcgcttagcgcgggtcttcgtgtatccggtgcttgcaatgatgtacattgccgccgcaagcttccgggagtgctgcgaccgaagaagtcgtcgcggcactcccggacgcgaccgggcagaagtgacgcccggatatacaggcagtcaggagccgacagccgttacaactgcaccttctccgtccgcttgccgacgaaatcgcccagccggccctggacgtcgtcgatggcggtctggaccatgcacatgatcaggccttcggtataaagaccgtcggtggccgacatgtccgagatcttgttgatcgcggtgacgatggcgtagttcgacagccgggcattgccggcgatcttgcgggcgaggtcgagtgccgtcgcgcgggcgtcgtcggcgatgtaatgggcaaggcccaggcgccgcccctcttccacatcgatcacgcggccggtcagcatcagctcgatcatccggccgggggtgatgatacgggcgacgcggacggtcgcgccgccgccggtgaagatgccgcgctggccctcgggcagggcgaaataggcggtgcggtcggcgacgcggacatgggcggcggcggcgagttcaagcccgccgccgaccaccgcaccctgcatggccgctacgatcgggatgccgccatgctgcatcttgtcgaaagcgcggtgccagccctggcagacccgcatgaattcggtcggcgagcggcgcttggcgtggtgttccttcagatccaggccggcgcagaaatgcgggccttcggtctggagcacgaccgcgcccacctcgggcggcacattggagaagaaggcgtcgatcttcgccacggccgcctcgtcgagcgcattgcgcatctcggggcggttgatagtgacgatcgcgacattgccgtcgatctcgatcttgagcacgtcgtcggacgagggggcgggaatggtggtcatgctggctctccggatctgctggcggaatgcgccgcgcgcggcacacggtgccggcgtctcatcggcaggcatacgctgaaatcccgccggaaaaaatcccacgacccgccgcccgatatgcataatccgccaaacttcatccccccatgccaggagggcggagacatgcacaccgatgccggcgacacgctctccaccggtttcgtgcacgggctgctggaggcggcagccggcatcaccacgcccgaccggctgcgcggcttcgtggcggcggccggcatcgcccccgacctgctggatgccccggcggcacgcgtgacccgcgaccagatggtggcgctgtatcagcaggtggcgatcggcaccggcgacgagatgatggggctgtggtcgcggcggatccgcaccggatcactgaagctgctctgcaccgcgatgctggatgcgccctcgatcctgaccgcgctctatcgcttcacccgggtctggaacctgctgctcgacgactggcggctggagtgccaccgcctgggcgagaccatcgaggtgacgcttgagagggcagccgacgacgccgtcacccgccccttcggccatgcgctgatgatgaagctgcatcacggcgtgacctcgtggctggccggccgcgagaccccggtgaccggggtggacttcgcctttccggccccggcccatgccgccgatcatgccttgctcttcccctgccccgtgcgcttcgacgcgccggtcacccggctgtgcatgccggccgcgatcgggcgggagagctttcggcgcagccggcaggagatgctgcccttcctgcatgccgcgccaaggcagtggctgttcaccacgctgcgcgagccgcagatggccgatcgggtacgcgacgagctggcccgccatctgtccggccccacggatctggcgacggtcgccgcggccctcggccagtccacccgcagcctgtcgcggcggctggccgaggaaggcaccagcttccgggcggtgaaagaggcgctgcgccgcgacgtcgcgatccgcgagctgacccgcaccgaccggccgatcgcggcgatcgcagccgagctgggcttcgattccgccgcggtcttccatcgcgccttcaaagcctggaccggcagcacgccgggtgcctatcgccagcccggcggcggcgcggccggcggggagagcgccgcccctatttcccggcgcggaacacgagcgggttcatgagccccttgggatccaccgccttgcgcagccgggcgatcagctcggcgcgcggcttcgggcagcgtttggcataggaggcggccttcagccggccgatgccgtgctcggcgctgatcgagcccgaaaactggtcgaccacccggtaggtgatgtcggacacgccgtcgaccgcatccctggacgcgccagccgccagctgaacgttgaagtggatgttgccgtcgcccagatggccgaaggggttgatcagcgcatccggatgcacccgccagatcgcttccgacgccgcatggacgaaggcgggcacgtcggagacctgaaccgagacgtcgtgcttgatctggatgcccggcgccaggcgctggccttcgacgatggcttcgcgcagcagccagagcgccttggcctgggcctcgctttgggcaatcgtgccgtcggtgacgagcccggccgagaaagcctcttcgaccagccggtccagatcctcctgcaggcgctcgtcggagcggccggagatttcggtcagcaccgtccattccggccgcccctccagcgggtcgaccacgcccgccacatgggcgatagcgaaatcgatgccttggcgcgggatcagctcgaagctttccaccgcatcgccggtgaactcgcggcagagcgacagcagcttcggcccgtcggcgagcgagggcagcgcgaagaacagggtgcggctggcgcgcagctgcgggaacagcttgagcgaggcggccgtcacgatgccgagcgtgccttccgcgccgatgaacagctgcttcaggtcgtagccgacattgtttttgcgcagggtggtcagctccgacagcaccgagccgtcgggcagcaccacctccagccccagcaccagatcgcgcatcatgccatagcgcatgacatggatgccgccggcattggtcgcgatcagcccaccgatctgggcggtcccttcggcgccgaggctgagcgggaatttgcgcccggcatcggcggcggcacgctgcaccgtctccagcacgcagccagcttccaccaccatcgagaaatcgagcgtgtcgagcgtgcggatccggttcatccggcccagctgcagcaggatcgaggcaccgtcgagccccggcaccgccccgccgaccaggccggtattgccgccctggggcacgatcgcgatcccggcctcggcacaaagccgcaccacgcccgcgacctcttcggtcgattgcgggcgcaccacggcgatcgcccggcccctgtaaagcttccgccagtcctcgagaaacggcgccatgtcgccgtcatcggtgatcagaccgcgcgggccggtgatcccgcgcaggcggtcgatcagggtatcgggcgcgatggtggcggcggcaggcatgggtccggttcctccgaatgattggccgcggcgcgcatacccgaggtgacgagcgggccggcggcggggcgaggatggcaggcttgcagggcactgcccagggctaaattcatacatcggatttcagttgtcagacaactgacgtcatgctagtcgtgacaacaggctgcgccactggcatcaagaccccgagggggcccgttctgcgggctccacattcaaggacaaggcgcgacagacggggatgaaacacgtgaccgaccgcagcggaaaggcgccggaacgtcagttccaggcactcaatcgcccgaagagactgtccgacgagatcgcccggcagatttccgagcggatcgcgaccggcgtcttcgccccgggcgaacgcatgccgaccgaggccgaactcgccgtcgagttcgccgtgggccgcagcgccatccgcgaggcgatcgcaaaactgaggcaggaaggcctggtcaccacccgccagggtgtgggcgccttcgtgaccgaggatccgggtgccgcctcgttccagatcgacaccgacgggctcaggaccatcgaggatttccgtcatgtgatggaactccgcatggaactggaggtcagcgtcgcggccatggccgcacgccggcgcagccgcgcccagctggagaaggtcgaagaggcgttccaggccctcaaatcccggctggagcgcggggaagcggcggtcgacgaacagcacgcctttcaccgcgcgatcgccatcgcgagcaacaacccgcatttccgcgacttcatgcagttcctggcctcgcgcatccgcgtggcgctgtcggtggaaaccgaacgcgcgaccggcggccgcgatgccgcgcgcaagctgctgcgtgaattcgaggggatcctgacggccgtccgcctgggcgatccggacaaggcccgccgcgcggcctggttccatctgctcagatccgccgaccgcctgggcctccgcggcctgcagggttgggaagaaagcaggatgaccttgatcggagagaacctcataccggtctgcgcgcccgcagatccgcagccccgcaagccgcgcttcaccccgccgccgggcgcctgcgactgccatgcgcatattttcgggccggaaagccgctacccctatacgcggcaccgcacctacaccccgccggatgccctgctgccggcctataagcacatgctcgccacgctgggcatccagcgcgcggtgatcgtgcagcccagcgtctacggcaccgacaaccgcgcgacgctggatgcgatccgcgccggcggcccggatttccgcggcgtggtagtggtggacgagaacatcgacaccgccgagatggaacggatgcacgaggccggcgtgcgcggcgtgcgcatcaacctgctgttcaagagcgggatcgaggtctcggacgtccgccgtctggccgagaagatcgcccccttcggctggcatatgcagatgctgatcgacgtgtcggaattcgccgacatccgcgagaccctgggccgcctgccggtcgatgtggtcttcgaccatctgggccatatgccgacctcgatcggcaccgaccatccgggctttcaggagatgctgtcgctgctggccgacggccgcgcctgggccaagatctcgggcgcctatcgcatcacctcggccagccgcacgccctatgacgacgtggcgccctatgcccgcgcgatcatcgcggccaatccggaacgggtggtctgggccagcgactggccgcacccctacgtcaacatcccgatgccgaatgacggcgacctgctcgacatgctcgacgactggtcgcccgacgccgccacgcgcgaccgcattctggcaaccaaccccgccaggctctacggcttcgaggagtcgtcgttttagcccctcgccgggcgggcgctcccgcgcccttggcccccgcctcaatggcgggagtcgttttagcccctcgccgggcgggcgctcccgcgcccttggcccccgcctcaatggcgggagtctgtcagtcccccggcccaagcgggcgctcccgcgccctcgcccccgtctcgcgaactgcctgaaaagcaagaggaacgcacccatgggtttcacccgacgcacccttctcggcgcagcactcggccttggcgcgctggtcgccaccgtgccggcgatggccgccgacgtgaccctgaagctgggctggaccacctctgacggtgccaccgacccctatgcgattgcggcgcgcgacttcgccgcggcgcttgaggcagagatgcccggcgtgttcgaggtgaagtacttcccgaaccgccagctgggcgacgagaaggaaatgatcgaaggcatgtccttcggcaccatcgacggcggcatcatcaccaatgcggtgatcgccaatgtcgagccggccttccagctgctggacctgcccttcctgttcgcgaacgaggcccaggcccacaaggttctggacggcgatgtcggccaggagctgatgggcaagctgcgcaaccgcggcatcatcggcctgggcttcgccgagggcggcttccgccacatgatcaacaacacccgcccggtggcccagcccgacgacgtgtcgggcgtgaagtaccgggtgatgcagaacccggtcttcctggaaatgttcagctcgctgggcggcaacccggtgccgatggcctggggcgagaccttcaccgccgtgcagcagggcacgatcgacgggctggaaattccggtcgcggtcatccaggccaacaagttcgccgaggtcaccaagtatctttcgctcacccgccatacctattcggcgctgggcgtgctgatctcgaagcgcagcttcgagaagatgaccaaagaacagcaggaggcggtgctgcgcgcggcccccaaggcgatcgccgcccagcgcgcccaggtggcagacaacaccaggcagatcatcgaagagctgaaggccgccggcatgacggtcaacgagatcagcgatcccgccgccttccggtccaaggtgaccggcgtctacgaccgcttcaagccgcggatcggcgccgagttgatggacaaggccctcgccgaggtcaactgaccctggtgacggaccgtccggccggcagtgcgccccccgcgctgccggccggatgccattccggacctgcgcatcccccgatcctgacggcagacggtgccccccatgtcggctttgctccagaccctctcgcgcgggctcgcccgggtgaccggctgggtgatcgtggccatcaccaccgtgatgatggtgagcctgatcctccaggtgttctcgcgctatgtgctcggccagggcttcacctggaccgaggaactcgccctgttcctgttcacctgggtggtgctgctcgccgccacgaccgcgatccgcgacgacggccatgtccgcctgcagctgttcatcgacctgctgcccggggcggcacggcgcatctggatgcgctgtctgacgctgacggtgctgatcttctgcttggtgttcgcggcaaccggggccgaatacgtctcggccacgctgggccaggtttcggccgcggtgcaatacccgatcgaggcgctgcacatggcggccccggtgaccggcgtgctgggggcgatccacgccctggcccggctgctggctccgcaatcggtgatcgacggcacgcccgaaaccggaggcatggtatgagcaccgccgcagccgttctgctgatcgccttcgccgtctgcctgttcagcggcgtgccgatcgtcttctcgctgggccttgccgccatcgccgggctctgggctgccgatttcgacctgatcgtgctggcccagcggacgatttcgggcacccaggtcttcaccctgctcgccattccgggcttcgtgctggccggcgatctgatgatgcatggcgggctgtcgcgccgcctggtccggctctgccaggttctggtgcagcatgtgaccggcgggctcggcatggtcactgtgctctcggccaccttcttcgccgcgatctcgggctcggcaccggccaccaccgccgccatcggcggcatcatggtgcccgagatggagcgccacggctggagccgccgcttcgccgcagcactctccaccgccgccggcccgatcgggcagatgatcccgccctcgatccccatggtcatctggggcgtggtcgccgaacagtcgatcaccaaactgttcctggcgggcatcgtgcccggcatcctgatcgccatcgggctgatgacggtgtgctggttcgccgcccgcgcccagggcatccccaaggcgacccgccgggcgaccgcccgcgaactgctggtggcgctgaatgacggcaaatgggcgctggcggcgccgctggtcattctgggcggcatctatggcggcatcttcacccccaccgaggcctcggcgatcggcgtcgcctatgccttcgtggtcggcatgttcatctatcgcgagttgaaggtccgcgacctgccgggcattctgctccagtcgatgcgcaccaccaccatcgtctgcagcatcatcgccgtcgcctcggccttcggctggctggtcgccatcgaacagctgccgacggtgatcgccgaagccatactgtcggtctcgtcgaacccgatcgtcatcctgatgatgatcaacgtgttgctgctgttcatcggcgcgatcatggacaatgtggcggcgatgatcatcctgggcggcgtgctgaccagcatcggcgccagcctggggctggacccgatccatctgggcgcgatcgtggtgatcaacttcgcgatcggcatggccaccccacccttcggctattcgctgttcgtcggcgccgcgatcagcaggctgtcggtcgaagaggtctccaaagcgctctggccgatgctgctggtcaagatcctggtgctggcgctgatcacctatgttcccggggtggttctggccctgccgcggctgctcggctgaccgcgcccctccgacctgttccgaaccgcccccgccggccatcggcgggggccgtttcgttttgcggcaagggctccccgattcttagaaccttaagtttatttttgtccggcaaaattccttgacgcgattgtttcgcatgttacagtcgcgcctgaattgaacagtggcagtctgtagtccattcttcatcagctggggagcggcattcgatgaaggtctacgactcggtcctggatgccgtcggcgatacgccgatggtccggatccgccgcgttgcgagggagctgccggcggagatcttcgccaagctcgaattcatgaaccccggtggcagcgtcaaggaccgcctggtccgctacctgctggagcggtatgaggaagcgggcgcgctgacgcccgagaccgtgctggtcgagaattcctcgggcaataccggcgccgccctgtcgatggcggcggccgtccgcggcatcggctgcgtggtgaccatccccgacaagatgagccccgagaagatcgcccggatgcgcgccttcggcacgaaggtggtggtggcccccaccgccgtgccggcggaagcgcccgaaagctattacagccaggcccggcgtatcgccgaagagacgcccggagcgatctatccggaccagtacaacaacccgctgaatgcagccgcccattacgccagcaccgggcccgagatctgggaacagaccggcggccggatcgacgccttcgtctgcggcatcggcaccggcggcacgatcagcggcgtgggccgctatctgaaggaacgggatccgtcgatccgggtgatcggcgtcgacccggaaggcagcgtcttccacgaccagttccatcacggccggttgagcacaccgcatgtctatcaggtggagggcattggcgaggattatctggtcgaggcggtggatttctcggtgatcgacgacatcatccgggtcgacgacaggtcttcgttcctgaccgcgcgccggctggtgcgcgaggaagggctgctctgcggcggatcgagcggggctgcgatgtggggcgcgctgcaggtggcggaccgcttccccggcggccggatcgtggtgctgctgcccgattccggcaacatgtatcgcagcaagttcctggatgatgcctggatggtccggcatggccatctggcggctccgacggcagcaacgccgcaggccatggcggccgtggcaggtgcagaatgaccgccgtcgcagccgggccgtccgtggccgaatccccggtggcggccggcgtgatgccgggcgcgcgctgggccttcgccgaccgcatcgacctgatggacgaaagcctgcgcgagggcgccgaacgcgccagcgtgccgccggacctggacgccaaatgcgatctggcccgggcgatcgccgatgtcggcatccgcacgctggtggtcggcatgttccccgacgtgccgcagaatgccgagttgctggcacggctggtgcgccgccagcaggccgggcagctgcccgccgatctgcgcttcatggtcatctctcatgtcggcgtgaccatgcgccagacgctggccatgctcgacgaactggcgatcccgctcgacacggtgcatgtgatcgcgatccattcggtttcggatctgcagatcacccatctgtttccgaccattctgcgcaaggacggcgccgtcgactgggatcaggccgcctgggaggcgctggacgatgccacgcggcgggcgcgcaatctggactggctggccgatttcctgccggtggtgaccggctggcgcggcggcggggtgatggtcgggttgctggatgccttccgcgccgatcacggccatctgatgaatgcggtggcaaccgtggccgcggccggcatccgccagatccgcctggtcgacaccgccggcacctgcctgccccatcagctgccccagaccgtgggcgagccggtgacgcgcttccccgacatcgccttctacggccatttccacgacgatttcggcatgtcgaccgccaatgcggtgatggggctgtcgctggggctgaagggggtcgacgtctcggtcggcggcttcgccaaccgggccggacatccgccgctggccgaggtggtgatggcgctgcgcaaactctacggcgtggagctgccgggcgtggaccccagccggctgcacgggctgagccggatggcagagcggatctacgggctgatggaaaaccccgcccaggcgatcaccggcgtcgtcacccacagcgtgcagagcggcatccgtaccgagttgctgcgcaaggccccgcggatcttcgacgcgatcgcccccgaagaggtcggtgcccgactggtggcgatgttcggggtgcgcagcggtcgcgacgggctgctgcgctttctgcgcgaacgccagctgctcgcccccttcggcctggagccgacgcccgagatcgccgacgcgctgttcgaacatctggacgccgaatgggcccgccgcagcgccggcgcccgcgcaaggctgggcgagctgatcgaacagtatcaggacacgctgaacgcatccttctttaccgaagaggctatgacgtcatggctgagcgcgcatctgaccgccgtgcatatgaagacggcctgaccgccaccgccgccgcgaccgcgctctggccgatcttccgcgaccgggtcgccggcgccgatgaggaacagtggcgcgacatgctcgaccttgcggcaatcgcggccgccgggctggcgcaggaggacgggctggacccggtgggcgacctggccgtgcaccggatgctgtatgccatctatgccgggcggatcctggtgccctggtcgccgcaatggcgcgatctggacgatgtccgggtcgatctgctgcgccggacgctggaaaccggttgggaggcggccgaacgccgccggctgaccggcttcttcggccccctgccgcaagtgacggatttcgccggctgggccacgcatcactgccaggcccaccggtccaatgtcggccatccgctgttcgatttcctgagcgaccgggccagcttcgaccagctgcgcagcttcatcgttcaggaaacccccttcgacatccatttcggcgacatcgtggccatgatgctgccgggggtgcatggcggcgccaaggccgagttctcgcgcaatttctgggacgagatgggccgcggcgaccagcggctggcgcatcgccagctccggctcgacatgatgacggcgctgggcgtgcgcgaggatgtacatgtcaccgaggtcgaggccttctgcctggaggaacttcgcctcgccaacatgtatttccacagcgtgttcaaccgcgccctgctgccccaggcgatcggcatgatgctggccaccgaactgatggttcccgggcggctggaccggcagatccagggctggcggcgggtcgggctggatgacgacaccatgcgctatctgatcgaacacaccgtggtcgacatcgaacacgccgccggctggatgaacgaggtggtgctgccgatgctggccgagcgccccgaggtgatgggcgagatcgtcctcggcatggcccgccggctggaacatgccgccgcggtctgcgaccggatgatgatgctcctgcctgcggcggcctgaatgaccgccctcgccgttggagaccttctctcccaaacccctgccgctgagatcgtccttgccggctgcgggctgaggggcatggggctgctcactgcgactccggccctgctcgaccaccgcctgacggtgatcgatgcggggccgcggccggggcctggggcttttccgggataccggatccagtccaattcgaccggctcggatttcttcggctgggtggatccggcggggcccttcggccccgtgctggacgatccggccgtgcgccggctgcgcgagcaccggggcgccttcgatctggcgctgctggcaggcgccctcgaccgcttcggcgacaggctggccacgctgctgccgcccgaccggctgatccgggaagatccgctggtgcatgtagcggtggacaaagaggcgatcgggctgaccctcgcctcgggccgccgcatcgacacccgggcactggtgctggcgctgggcatcaccgagcccgcccatgacgctctcgccccctgggcggcgcgtacgatcccgtcgggccggatcgtacgcgaccatctggccgccctgccgcctctacccgcagacagaccggtgcggatcgtgatcgccggcggatcgcacagcgcctattcggccgccctggtgctggccgatgccgtggatgcgggccggctttcggccgaggtcaccatcctgcatcgcggacccgcccggctgttctacccgaacatggacgcccaggtcgccgagccgcatggcccgctggaggccctgcccgacctcgcccgcgacatctgcccggaaaccggccaggtctttcgctattcggggctgcgccaccgggcccgcgccctgttccgcgagatcgcccaaggcgcgcgccagggcttcacccagcggcagatcccggcgatcgacgatgcggccgacctgctggaccgggccgatctgatcgtccaggcgctgggctatcaaagccgcagactggccatgaccatcgacggccggccctgggatcccgcaggcggacgggccgtggtccgccccggccctgacggccggatcccgctgcccgaggggtcgcccgcgcagatcttcgtgatgggcatggacccctacccctatgacgacggcgcgctgaccccgacggggcagtatgcgttgcgtggcggccagattctggccgcccttgcccggccgcctgcggccggacagcccctccccctcgcagaacccgtatgaggtacggccatggcgcatatggtcttcgtggaaaccacccgccccgccacgcgggcgatcgatcatgcgctggccatggggcacgaggtgacgctgatccgctccggccgtttcgactggctgttaccgcccgccgagcatgagcggatccgcacgctcggcatccgccgggtggagatcgccgacacccgctcggatacgctgatcgaggcggcgctgcgggatctgatggccggcgggccggtcgatgcggtgctgaccgccctgcagccggcggccaccccggcggcgatcgcggccggccggctcggcatccgggccacggcggcacggggcatgatcaatgcccgcgacaaggcgctgacgcgggcggcactcgaccgcgccgggctgccctcggtcgcccatgccaccgtccgcacgctggaagatgccctcgacgccgcggcgcgcatcggctacccggtgatcgtgaagccggtgaacggtctgggcaaggcactgaccacctgggcgaagacgcccgacgacatccaccgccatttcgccaccctggccgaacgccgcgaggtgctgcagaccggtcttgccgacgagctggccgatgccgctttcatcatcgaagagatcgcccgtggcccgctgcattcgctggaactggcgggcctcgcctcgggcgccaaggtgccgctgatcctggtgcggcggaagaccggccgtgacgatccggttctggagatgggctccaccgtccccgccccgctttccgccgaagaccgccgggcggcgggggattatgcggtggccgtggccgaggcgctgggcctcgacatcggcatcttccatatcgagttgatcatgaccgacagggggccgcggctggtggaggtgaacccgcggattgccggcggcgccatccccgatctgatccgcaccgccaccggcatcgacccgttcgagctgctggtgcgcgtccatgccggcgaaagcccggtttcggactggctgcccgagacctgtgccgccagccacagcttcatcaccatggccgaagactgcaccgtgcgcgccgatctggcacccgactggttcgaagccttccggccgcgcatggcctcgggtggttgcgacatccgccccggggccagctaccggcgcatggacggcaaccaggacgtgttaggtgttgttcgaatggttgcaccaaccatcggcgaggcggccgccgcctgcgaggcgctgcgggccgagatcgccgaaacactgggcgtgaaactggtggagctggtcgaatgagcggcaccaccccagccctgccctcgcggcttgcgctcttcgccgatcggcggttcctgctgctctgggcggcgatgctggtcagcgccaccggcaccttcatgctgctgcttgcggtttcggccgaattactgaagcgccacggctcggggctgggtgccgcctcggtcttcgcctttcagtggatcctgccggtggtggcggtgtcgctggtccgccggctggcggaaagccggcggctgcgccgcacggtgatcctggccgaaatcgccggggccgtgatctctctggcgatcggcctgctgctgaccgccgatctgaccgtggcggtgctcgcctgcttcctgatccggggcctggccgaagcggtgaccaagacctcgcgggtggtgctggtcaagctgatgttccaggggccggcgctgacgcttgcctcgtccaccttcaacctgtccttttatgtcggcggggcgctgggcgggctggcgggtgcggtggcggtagaacatctgccgctgatcggcgtctgcgcggtcgacgccatgaccttcctgatctcggccgcctgctatcgggcgctgcccgatctgaggccggccgacgacgcagccccccgcgcgcccggccggcgaaggggcgcgattgccgaagcgctgacgctgatgcgcgccgatcggcggctctggctggcggcgggctatgtcgtggccgcaaccggcgtgctgcaggggtttcacaacaccgcccgggtggtgctgcccatgcgccatctggggctggatgaaagcgcggtgatgcatctgcagatcaccagcggcctcgccatcatcctgggggcggtggcgatcccggtgctgggggcgctggcccgccatcgcagcttcgcgccgctcacccatctgggggcctgcgtgatgctttgggcggtgacgctggtcgccggcgagacggggctacatctcggctatttcgcctatatcttcctgttcgaagccgccttcaccgccgcccaggcccagctgatccaggccacgcccagccgcgacatggccacgatgcaggcggcggtgggggcgctgggcaccagcctgctgatcggctgcacgctgttgagcggcgcgctcgccgatctgatgccgctgccggtggtcgctgcgatcacggccgggatcggggtcgtcatcctgctcggcatcgaggccggcagccgccacggcagccgcaaggcggccggtatctgatgaaggcccatatctggtgaagggactgctgcacgaccgcaacttcctgctgatccaggcggcgacgctgatcagcgccaccggcagcttcatgctgctgctggcggtttcggccgagctgttgcggcggtcgggatcggggctgggggcggcgtcggtcttcgcctttcaatggatcctgccggttctggcggtctcggccgtgcgccggattgccgatcagccggggctgcggcgggtgctggtcctggcggaactggccggcggcgcgctgtcgctcgccatcggcctgctgctcacggccgatctgctgccgctcgtcctcggctgcttcctgctgcgcggcttcggcgagggggtgacccgcaccggccgcgtcgtcctgctgcgccggctgttcgacggcccgcgtctggccgcggccgcgtccagcttcaacatcgccttctacaccggtgccacgctgggcggcgtggcgggcgggctggtggtcgggcggctgccgctgaccgaaatctgcgccctcgatgccgcaagcttcgtggtggcggcgttgtgctggcgggcactacccgatgcacgcggcagcacagatacaacaaaaagaagtagcggcgccattcgcgacgccctgcggctgatggccggcaacccggccctgctgcgtcaggccggctatgtcgtgctctcgaccggcatcttccagggcttccacaatgccgcccgcaccctgttgcccatgcgcgggctgggactggacgaccgggcggtgatgcatctgcaggtggcaagcgggcttgccatcatcctgggggcggtgctggtgccgctgctgggcgggctctcccgccgccgctggctgacgccctgcgcctgtgctcttgcctgcctgctgctggtggccgccagccgcgcccccgggctcggcctgctgatcgccgcctatctggccttcctggtcgccttcgaactggccttcaccgccgcccaggccgggctgatccaggccgcaaccaccagccagatggcgaccatgcaggccgccgccaatgccggcggcacggccctggtcatcctggtgacgctggcgaccggcgggctggccgatctgatgccgatggcggccgtgggcccggtgatcggcgttgcggggctgacgctgatcgccgggctggagctggtggcgcggcggactcgggcaatgctgtctcaggcgatgctgtcgaccacgccgccatccacccgcagggcggcgccggtggtggcggacgacagcggcgaggccagatagaccgccagattggcgacctcgtccaccgaggcggcgcgccggatcagcgagcccggccggttgtcggccacgaaattcgcggcactgtcttcgatcatatccccgtccaccggccggccatccgcctccagcatgcgccggagcccgcgggagagggtcggaccgggcaggatggcattggcggtgacgccggtgccggccagccgcttggcgagcccccgcgacagggcgagataagcggttttggtgacgccgtaatggatcatgtcggccgggatgttgagggcggattccgacgacaggaagatcacccgcccccagccgcgatcgaccatgcccggcaccagcgcccgcgacaggcgcatgcccgacaggaagttgaccgccaggatctgctgccagagatcgtcatcggcctcgaagaaatcggccggaccgaaaaagccgacattgttgaccagaatatccggatgcgcgaccgccccggccagggtgtcgcagccggtttcggtaccgagatcggcggcgatgccgcgcacctccgccccgggaaccgcctgcttcagctctgccaccgcctggtcgacatccggttgacgccggccgttcagcaccacggacgcccccgccccggccaggccccgggcgatggcatggccgataccggcggtggaaccggtgacgacggccgagcggtcggtgagatcgatcttcatcgggtttgcctccaaacgactgcgggatcgtttgaggtgcgaacgccgtggcaggcgatgcgttccgccggcggcggctcagcgatagccggtgggatcggcggcgaggcccgcctcctgaacctccaccagatagcggaaacagtcggggcgcgagccgtcgaggtcgtcgatgccgtagatccgggccagatcaccgctggaagtcgaggccccgttccagcgcatccgctccggatcggccgccagcgccgcaatgccgcggccaaggaaacggggggtttccgagatgcagaaatgcggttcccgcgcaatcgcctcgcgccagccggcctcggtcacgccgtaatggtcaagcatcatctcggagcgcatccagcccggcgtcactgcgaccgaacagcagccatggggctcaagatcgcggccatgggcccaggccatgcggatcaccgacatcttggccagatcgtagaagggcgacagccggtagcggccggcattgtaatcggcggtgccgtcggtcacctcgaccagaaccccgccgggccggcggatcatcagcggcagcaggtgatgggcggcgatcagatgggtgtcgaccgcgttgtgcagcagccgcaaccctctgtcgagatcgtgcccccagaccgggacgttccattcggtcagcaattcgccgccccagacatcgttgaccagcaggtcgagccggccatgggccgcgtcgatccgggcggcgagcgccgccaccgccgccgggtccagatggtcgagcacgaccggaatgccgcagccgccggccgccgtgaccagggaagccgtttcctcgatcgtctcgggccggttgtagtccgagcggcgaccggcggtggagcggccggtgacatagaccgtggccccggcggcgcccagctcgaccgcgattccgcgcccggcgccgcgcgtcgcgccggcgaccacggcaatcctgtccgaaagagccgtcatgaaccctgcctccctggatacggcgcttccatctgcgccttggataatttataaacgaatattcatttataatggaatcccgagatctgcaaggggaggacgacatggcccgccgacgcagcctgcccgatgaccggattctggagatcaccctcgccctgatgcaccggctggggccgcaggcggtcaccttcgcagcggtggcggcggaaaccggactttccggcgccacgctggtccagcgcttcggcagcaagccggcgatgatccgggccgcgctcgatcttgcctggacgcggctggagaccgccacggccgaggcgatcgccgcctgccagccgacgccggagggcgccgtcgccctgctcgccgggctctcccagggctatggcgacatcgacagctatgccgacgggctgatggtgctgcgcgaggatctgcgcgacccggagctgcgcgcccgcggcacccgctggggcaacggcctggcggcagcgatcgaccgctgctttcccggccagccgggtgccggccggttgatgatcacccaatggcagggcgcgctgatctggtggggcttcgcccccgaccggccgatcgaccgggtggtggcggaagaacttggcagcctggccggtctgctcgccggacggccggtcccggcggaaccggccgtccgcggatgactgcgccccggtctcaggccgtggcacccagatcttccgagatgatccggcagcgttcggccagcagcagggcggccggatggtcggggtcggcaagggcacggtcggtgccgatcagggtcagcacgcattgcgcctcgttctgccagtcgagcacggggctcgaggcggcggcaaggcccggcaccaccgaaccgtcgacggtggcgacccggcgggcgcggatctccgccaccagtgcgtcgacatcgaccggcggcagatcccggccggcggcacgggtttcggtggcgagcaccggcgcggtgacgctttcgggcagccaggccagaaaggtgcggccggtggccgagcgcagcagcggcatcaccgagcccaggctgagcgcccccacgaagggcacgcggctgcgatgcagccggacgacgacggcaccgtgcaggctccagaccgccagatgggcggtgaaccccgaggcctcggccagcgccggcagttcggccgcggcccgcgccaccggatcgagccggcccatggcggccagccccagctgcaaggcgatcggccccagatcatagcggccgccatcgccatcctgcaccaccagcccgtcgcggacatagctcgccagatagcgatgggcattgctggccgagatgccggccgcctgggcgatcgccttcagcggcagcggcccgccggcccgcatcagcaccatcagcacgcggttgccgatctccaccgactgaatgccgcgcgacccggcggccgcgccgatcgcgcccccctcttccagctcgatcgctgccatggcggggtcctgtcctcccattgttttcggcgccttgcggcagatcgccgccgcggcgatcgaccgcatcgacgcctgtattggcgtttgcttctgagcaatcgttttgctaatagagaatacagagcccgaagacgggtgacaacatgtcgcaccgacggccggcgatcttcagtgtcgccccggcccaacggtcgcacagcagaggccgggtcatcagcgggtcgcgtgggaaacgccgccgtcctcccggcatgtgcccatggaggaattcagatgaccgctcccaccgcttccggccccacctcttcaggactccctgaaaactacgccgccgaactcgaccggctggacatggcgccgctctggacggtgctggccgatctggtgcccgaacatccgcgcccgaaggccgtgccccatctctggccctatgcgaccgcgcgcgaggtgctgctggaaagcggccggctgatttcggccgaaaaggccgagcgccgggtgctggtgctggaaaatcccggccatcgcggcgagcatcgcgccacggcgtcgatctatgccggcctacagctgattctgcccggggaacgggcgcccgaacaccgccatacccagtcggcgctgcgcttcgtgatcgaaagcgacggcgcctataccactgtcgaaggtgcgcgggtcgacatggcgcccttcgatctggtgctgacgccgcgctggcgctggcatgcccatggccacgacggcaaacagccgggtgtctggctggacgggctcgacatcccgatgatcagcctgttccagggcggtttcgccgagcggatcggcgacaacgaggcccccgcccgccgcccggacgtgtcgcccgccatgcatgccgcgggactgcggccggcggccggcactgccgccgccgcccatggcctgctgcattatcccttcgccagctggcgcccggcgctggatgccgcgcgcgcggccgggggcgtggagccccatgacggcgtgcggctggaattcaccgatccggccaccggcggcccggtgctgccgacgctgtcggccttcgcgcagctggtgccggccggcaccgccacccgggccgtgcgccgcaccgaaagcgccatcatcgtcggtgtcgaaggccgcggcatgctggaaatgagccgcgccgacgggagccgcgtggcgcttgccatcggcccgcgcgacgtggccgtgataccctcctggtccgatctgtcgatcaccgccgaagccggcgaggacctggttctgttcagcctgtcggaccgcgccgcacagagcgcgctcggcctctatcgcgaggaacgtgcatgaccaccgctgccaccagcccggagatcaccgccggcggcaccgcccccaccgtcatcgtgcccgtcgagggcggcggcggcttcgcggtgcgccgggtgttctgcgtcggccgcaactatgccgcccatgcccgcgagatgggccgcgacccggatcgcgagccgcccttcttcttcaccaaatgggccgaaagcgtggtgcccggcagcggcgccatcacctatccgccgcgcaccgccaattatcaccacgaggtcgaactggtggtggcgattgccgaaggcggcgccaacatcccgcaggaccgggcgctggatcatgtgttcggctatgcggtcggcctggacatgacccgccgcgacctgcagctggccgcccgcgacctgggccggccctgggacgagggcaagaatgtcgagcagagctgcccgatggcggcgctggtgccggccgcccgcatcggccacccggaacggggccggatcgtgctgacggtggacggcgcggtgcgccaggaggcggaccttgccgacctgatctggagcgtgcccgagatcgtgtcgatcctgtcggagagctggacccttcagcccggcgatctgatcttcaccggcacacccgcgggcgtcggtgcggttgtgccgggtgcggtgatgcatgccgagatcgacggcctgccggcgctggacctgacggtggtcaaggccagctgacggacgagagacgggtgcggccggcggggaatgaccggccgccccttcatgacattggggaggagacgaccatgcgcggtttcatcgcggcggccttcggtgccgccctcaccttcgccgggctcggcggcggcatcgcgccggccgcggcgcaggagacggtgacgctgaagatcagccactatctgccggccagccacggcttccagaccgatttcctgggcccctgggcggaagagctggagcggcgcaccaacggcaaggtgaaggccgagatctatcccggcaccagcagcttcggcaatgccgcccgccaggccgatcaggtccgcgccggggtgatcgacatcgcgctggggctgcgcggcattccgcgcggccggttcgagcgcagctcggtcttcgaactgcccttcgtcgtcagcgaggccggtgccggtacgaaggcaatgtgggagatgtataaatcgggtgcgctggccgacgactacaaggattacaaggtcctggcgctgttcgtgcacaatggcggcctgttccacaccacctctgtccccgtgcatgagctgtcggatctgaagggtctgcgcctgcgcacgccgagcgaggcggtgtcggtgatgctgcagtcgctgggtgccagcgccgtgggcctgccgccgagcgagatttacgagaacctgcagaagggcacgctggacgggctggtcaccacctgggacctggtcggcgccacccggctgaacgaggtggtcaagtaccacaccgacggccgggtctataccgcggccttctacgtactgatgaacaagcgcaagtatgagagcctgcccgccgacgtgaagcaggcgatcgacgagaccaccggcgatgcgctggtcgcgaagttcggcgactggtgggcgaagtgggacaaggccggccgcgaggacgcggtcgcgcgcggccacgagatcatcgagatcgacgaggccacccgcaaccgctggcgcgaagagctgacgccgatgatcaacgcctatatcgagcggctgcagaacaacggcgtcgccgatgcccgcgcgctctacgaccaggcccgcgacctcaccgcccgctacgaggccgcggaatgaccaaaagcccctcggcatcgccccggcccgcacgcggcggtgccgtccggctgatcgacggcctgatcgaggcggcggcgctgttcggcgtcgcctgcctcggcatcgggatcgtcgccacggtggccgatgttctcggccgccaggttctcggctttcaggtgaccggcaccgtcgacctcacccagctggcggtcgttacctgcgcctttctctccctgcccttcggcttccgccgcggcgcccatgtcgcggtcgaactgctcgacgaccggctgccgcccgcggccctgcgtgcgctggatctgctggccggcatcgccgggctggcggtcatgttcgtgatcgcctggcgcggctggggcgagctggagctggcgctcgactatggttcgatttcgcaggatctgggcctgccgctctggatccatcgcggcctggtcgtggccggcggcgcgctcggcgtgctcgcctgcctgatgaacatggccgaggccctgggtctctggtcacgccccgcgcccgctcctgccggcgcctccgtctccgtcaacgagggctgagttcccatggatctgacgatcggcgtgctcggcttcgtggccgtgctcgtgctgggcatcctgcgcgtgcccgtggccgtggcgatggccgtggttggcctggccggcggtgcggctctgggcgggctcgacggcattctctatctgtcgggcaccctgccctatgacgccgtctcgccctatggcctgtcggtcgtgccgcttttcgtgatgatgggcgtgttcgccggccgcgccgggctgtcgcgggcgctttacgatgtggcggatcttctggtcggccgcttccgcggcggcctcgccatggccacgatcggcgccagcgccggcttcggcgcgatctgcgggtccagcctcgccacctgtgcgaccatcggcaaggtggcgctgcccgaaatgcgccgccacggctatcccgacgacctggcggcgggcgcggttgcagccggcggcacgctgggcgtgctgatcccgccctcggtgatcatcgtgctttatgcgctgatcaccgaacagtcgatcggcgcactgttcgccgctgccctggtccccgggctgatcgccaccctctattacatgatcgccgcccggatctcggcccgccggctgccgcggcgcggcgagcgcccgcaggacgccgcgcaaaagcgcggcgggggcctgcgcctgctcgccatcgccgatatcgtggtgctgttcggcctggtgatcggcggcatctatgccggcctgttctcccccaccgaagcggccgcgatcggtgccggcggtgccgccctgctcgcctgggtgcgcggcgggctgaagggcggcgagctgcgcggcgcgatggtggaaaccgcgctcacctcgggcatgatcttcctgatcctgatcggcgcggcgctgttcaactatttcgtcgagacctcgggcctgccccaggcgctggtgggtgcgatcgcggccgcgggcctcggccagctggaagtcatcctgctgctggtcgccttctatctggtgctcggctgcttcatggacagcatgtcgatggtgctgctgacggtgcccgcagtcttcccgctgatccaggccagcggcatcgatccgatctggttcggcattctgctggtgacggtggttgaactcggcctgatcacgccgccgatcggcatgaacctgttcgtgctgaagggcatcgatgcccggctggatctgggcgtagtgatccgcggcgtgctgcccttcatcggcgccgatgtggtgcgggtggtcacgctgatcgccctgccccaggtcgtgctgttcctgccccatctgctcggcttctgaggaccctgcccccatgaccatcgaacccgataccggcggaaccgataccgtcttccacggctatttccgctcctccgccgcctatcgctgccgcatcgccttcaacctgaagggctttgcgcccgcgcagcgcttcgtgcatctgcgcaagggcgaacagaagagcgccgcctacaaggcgctctcacccgcagggctggtgccggcgctggaaacgccgcgcggcgtgctcacccagtcgctggcgatcatcgaatggctggacgagaccatgcccgatccggcgctgctgccggcggatgcctggacgcgtgccaaggcccgcgccttcgcccagaccatcgcctgcgacatccacccggtgaacaatctgcggatcctgggctatctcaagaccccgctcggccacgaccaggcgacggtcgacacctggtaccgccactggatcgccgagggcctgagtgccgcggaagccctggcgcaggatgccggcggacacggcagcttcctgttcggcgatgcgccgggcctggccgaaatctgcctggtgccccagctctacaatgcccgccgcttcgcctgcccgatggaggcctatccgcggctgctggcggtggaaacggcctgcaacgccctgcccgccttcgcagacgccgcccccgatcgccagccggacgccgagggttgagggccagggtcgggacgtctcagacctgaaaaacgggcggacgaagatcaggctggtaaggccatccgctcgtttttcgtttcgcgacggcctggaggaccgccagatcagacatcgtcctcgtcctcatcgagctgatagacggggcgaggttccgcctggccggatgtcagggatgcgatgacggcaagaaccgccggcaatgccttgcgcggcacgagcacgggttccagatcgagcacccgggccagttcgatcaggctggagagctgcagatcgacggtgccggtctcgatcttcgagatgtgactctggggcaggccggtcagcgaaccaagggcccgttgcgtaaggcccttgccccgccgcgcggccttcagctcctgggcaatgtcgggaatctcgtacatctgatctgctttcgtatatatcgacctgcgcgacatatactaaaacagatcaggctctcccgcgacctcaactccgggcgccggcagccttcgccagcatggccacggcgcggtcgacctcggcctcggtggtgaatcggccgaggccgaggcgcagggccgccgtcacccgcgcatcggcgagtttcagcgcccggagcacgtaggacggctccaccgccgccgaggaacaggccgaaccggccgacatggcgatgtcgggcagcgcccggatgatccggtcggcctcggtgccggggatcgagagattgaggttgtgcggcacccggggggtatggccgggggcatcggtgccggtaaaggcggcaccgttgatttcgggcgtgagcccggcggcactcaacccagccagcaggcgcagatgcagccggccgatgcgctgcgtttcttccggcccttcctgacgcgccagacgggccgcctcgcccaggccgacgacaagtggggtcggcagggtgccggcccgcaggccgcgttcctggcggccgccatcgaacagcggctggatgcggtcctcgatcccccggcgcacgaacaatgcgccaacgcccttggggccgtagatcttgtggcccgacaggctgagcatgtcgacggggacacggcgcaggtcgagcgggatgcgccctgccgcctgggcggcatcggtgtggaccagggcgccccgatcatgggcgcgggcggcgatttcggcgaccggctggacggtgccgatctcgttgttcaccgccatcaccgagaccagcagcgtgtcgtcgcgcagcaccgccgcgaccgcatcggcccgcacgatgccgtcgggaccgggcggcaccaccgtcacctcgaagccatgggctgcggccatgcgctcggccgccgccagcacgcagcgatgctcgatcgcgctcaccaccagatgccggcgcggatcgccggccgccaccgccgccagcgccacgcccttgatcgcgaggttgttcgattcggtggcgcccgaggtgaagacgatctcgccctgatcggcgccgatcagggtcgcaacctggcgccgcgccttgaccaccgcggcatcggcatcccagccccagcgatgggtggcggaatgcgggttgccgaactgggtggtgagatagggcatcatcgcctcaagcacccgcgggtccatgggcgtggtcgcctggttgtccagatagatcggcgccgccggacagtcggtatcgtcgctcatgcggccgggagcctccatagcggtcatcgcatcacgtctccgtcaccggcccgatcggggcccccggttgtcgttccgtcgcagtcggcacccgccggatgacgcacgcgccgcagatctcattcggccgcagcccggttccgccgggctgccatgcggcaccaggcggcgatgaaggcctcggcgtcatcggccgtgctgccggcccccaggctgaccctgatcgcctggccggccagatcccccagccccatcgcggccagcaccgggcttgccgccaccttgcccgaggagcaggcggagccggccgagaccgcgatgccggccagatccatccgcatcacctgggtttcggcggcgatgcccggcagcaccaccgacagggtgttggcgacccggccgaaggcggcatcccgccccgggaacaggacatccggcgccgcatcggcaagtgcggcctggatccggtcgcgcagcgccgccagacgcagcgcctcggccgcccgatccgtggcgccgagcaccgcggccgccgccccgaaaccggcaatgccggccaggttctcggtaccgccgcggcggcggtattcctgcccgccggggatcagcgccgcaggttcgatctccggccccgcgaccagcacgcccacccccttggggccgccgatcttatgggcggagagtgacaggaaatcgacggcaccgcacaaggttccgaggtcgagccgtccggcggcctgcaccgcgtcgcaggcgacgcgcccgccccgggcatggaccagcgccgcgatctccgccaccggctggatgaccccggtctcgttgttgaccgccatcaccgcgacgagcgcaccggcgccgccatccggcagccgatccagcatggccgcgaccgcatgcgggtggacgacgccctgatcgtcgaccggaatgcgcggggcatggggcgccgccgccagcacgctgtcatgctctacggccgacaccgcaagcgggcccatccccgcctgatgtagcatccaggcattggattcgctgccgcccgaggtgaacagcacacggtcgggccgggcgccgcagagtgcggcgatctcggcccgggcctgttctaccaccgcccgcgcggcgcggccctcggcatgaaccgaggacgggttgccggccagatccagcacctcgatcattcgcgcccgcgccgccggcagcaacggcgcgccggcattgtgatccaggaaatgacgcacggcaccggtcatgggtgatcaccccgatgcgccgcggccagatcggcgatgctgacccgggcgagcctgtcgcggaccccggcatcgaccgcctgccagagggcgaccacgccgcagccgaaacggccttccaccccccgcagccggccatcgccaccttcgaccgcggccaccacatcggcaacgctgatcgcctcgggcgcgcgggtcaggcagtagccgccggcagccccccgggcgctgcgcaccaggccgcgccggcgcaacttgcggaacagctgctccagataggcgggcggaatgtcggcacaggtggcgatgtcggaaatgcaggtcggcgtggcgcagcgccgccgggccagttcaaccatggccaccaccgcataatgcgcgcgcgcgcccacccggaccacgcccgacccgcccgccgcctcacgcgcggccgggcgggcgcgccggggcagatcggcggtcccggaacagtcgggctcggcggtttcgatggcggcactgtcgaagctgtcgggcatggggcgcagcctgggctttgtgaattcgtaagaggtgctggtcagcgccggtcggcggcgccgggcaggcggtggatgcgggcttcggcatcggtgacggcccgggcatgggcgtcggggtcgagcccggcctccagctcgctcacccgcgccgacaggcgctgcacctcgctcaacagcccgtcgacgatccgcgacatcgggtccggcaggtccggggtgccgatcgcataggcgtcgaaacggcgcatctcttcgtccagcccgccgcgggccttgacgatccggcccgggatgccgaccacggtggcgcccggcggaacgtccttgaccaccacggcgttggagccgatgcgagcatcggcgccgaccgtgatcggccccagcaccttggcacccgcacccacgatggtgccttccagcacggtgggatggcgcttgcccttctcccagctggtgccgcccagcgtcacaccctgatagagggtgacgttgtcggcgatctcggtggtttcgccgatcaccacgcccatgccgtggtcgatgaagaagccatggccgatggtggcgccgggatgaatttcgatcgcggtcaggaagcgccccagatgcgacacccagcgcccgagcagcttgaaattccgccgccacagccagttcgcgacccggtaaatcatgatcgcgtggaagccgggatagcagagaatcacctccagccggctgcgcaccgcagggtcacgatcgaacaccacgtcgatctcgcgtttcaggctcttgaacatggcctcgcaccgtgtgatatcatccgccaccctgcgtccggcgacggactccgttttggcgccccgaccgctgcgcgcgacccgacgtcgtttcgacggactctacggatatccgaccgaaacagtcaagattgtccgtcatcaccggcccccatccgggcgcttagacgtcggcaacgacaatactgggagcagcaatgcccgaagtgatcatcaacggacccgaaggacgccttgaaggccggtatcaccacgggacggcgaaaaacgcgccgatcgcgctgatcctgcatccgcatccgcagcatggcggcacgatgaacaacaaggtggcctacaccttgttccagacgttcaaggcccgcggcttctcggtgctccgcttcaacttccgcggcgtcggccggtcccagggcagtttcgacaacggtcagggcgagctgtcggatgcggcatccgccctcgactggatgcagaactacaacccgaacgccaccggctgctggatcgccggcttctcgttcggggcctggatcgccatgcagctgctgatgcgccggcccgagatcgacggcttcatctcggtcgcgccgccggcgaatatgtatgatttcaccttcctcgccccctgcccgtcttcgggcctgatcatccatggcgaccgcgacgacatcgtctcgcccgattcggtgaccaagctgtcggcgaagctgaacagccagaaaggcatcaccatcgagcacaaggtggtgcccggcgccgaccatttcttcggccagcagctggagacggtggcggcgctcagcgacgattatctgacccgcgcagggctctgagcggcggatataacaggaaaggatccgcagacgcggatccttatcccgagcgcccgggcggcgtagtgcgtcaggccgggccggcaccgaattccgccgtcaggtgtttcaacacctcgtccagcccaccggtgaccctgtagcgcgtcgcgggatgcggcggccgctggtcgatgtccttgagcccgcttgcggtcatgatacagaccacgctgtcatccggaccgatgatcccgcgccggcgcagctgaccggccgccgcgatcgaggtaacccccgacaattcgccgaagatgccttcgtgacgggcaagaccggcctgggtctgccagagcgctgcatccgtcacaacctctgccgtcccgcccgaccggcgcaccgagaccagcgactggaaagtcccctgcaccgtgccgatggacagcgcccgggtcggaaacgggtcccgggccgtgacgagcgtatcggccggccgggcaaggctgtcgcggaccgacccatggatctcggccgcgaccatcttcggcaggcggtcgatgacccccgccgcgcgaagatcgcagaacccccgccagatgccgcggagattgtcgccataggcggtcgggaccacgacccagtcgggcacccgcccctgctgctgcaggacgagttcacaggcaatggtcttgtagccttcgatgccgtcgggatggctgcccaccaccggcgtctcgaagggcgaggtcacgaaccagccgaagcgcgcgaccccctcggccaggatcggccagcgcctggtcttgtcggcaagctcgaccaccacggcgccgtagcggccgatctgatcgaccatcggtcccggcgcgccctcgaaggtcaccaccagacaggtgagcccggctctggcggcataggcagccagcgacgccccggcattgccggacgacgcggtcgccacgaaccgatggccctgccgtttcgcggccgacacggccaccgccgaaaaccggtccttgtgcgaccaggtggggttgcggctctcatccttgatcagaagatttccgatcccgagacgccggcccagccgggccgccgggatcagcggtgtgtgcccctcgccgaggctcaccatctcgtccgcatcgaccggcagataatcagcgaaggcggcgagcccgtctgcgggcgacatctgcggcatcgtccgccgggcgaggctttccgcagtataggccacctccagattagacggggcatcgcgtctgcagatcccgcagcccctggaatcgatcggatgatccgcaggatatgccgcgccacagcgcaggcaggcatagccggccacccggggatttccccgggcgttcggatgaggttcggacatggccgtttcccgttcggtctgtgcgggggatatcaggaagtcgccgggcgccgccactgcagccacagcagaagtgccactgcggcaatggtggtcaggccgagcacgtcgctcagcgtgccgggaaagatcatgccgatcgcgccggcgaccaggatcagccgcatcaccggatgcagcggccgcagaaaccagccggtggcggcaatggagagcacggagatgccgatcacggcggtcagcatggcatggccgacctccagcaggcttccctgccccagcagggccggttcatagacgaagatgaacggcagcaggaagacgcccacccccatcttgaccgcatgcacgctggtccgccacggatcgccgccggccacggcagcagctgcaaaggaggcgatggcgagcggtggcgtgatgttcgacatcaccgcaccgaagaagatgaacatgtgcgccgccagcggctggaagccgaggtccaccatgcccggtgccaggatcgaggccaggatgatatagaccgccgaggtcggcatgcccatgcccaggatcaccgccacgatcatggtcagcgccaggaacaggatcgcgctgtcacccgcgacataggtgatgatgctggtgaaccgcacccccagcccggtgagcgagatgatgccggcgatgatcccgcccacggcacaggcggcgatgaccggcgccatcattttcggggcctcgatcgccgcttccagaaagatccggacgatccggcgcggctcccgccggtagcggacggtcagacagagcaggaaggccaggataccgtagagcccggccaacgacggcgtcagcccctgaagcagggtcgcgatcatcaccccgagcggcaggagcatgaacagcccctccttcaggatctgacggaggctttcaccgccggcatcccgcggcggggtcagccggttgcgccgggcctccacgtcgacggcgatgaagatcgcgacgaaatagaggaaggccgggatcgccgcggcgatcatgatgtcggaataggagaggcccaggaagtcggccatgatgaaggcggccgcccccatcaccggcggcgtgatcagcccgccggtcgaggccacggcctcgacaccggccgcgaattcccggttatagccgtatgtgcgcatcgccgggatggtgaaggacccggtggtgacgacattggcggtagagctgccggagagcatgctcatcatcgcactggagaggacggcggtcttggccggaccgccggtgacgttgccggtcagcgcattggcgaagcggctgaagaaggtgcctgccccggacgagaccagaagcgcgccgaacagcacgaacaggaagatgtagctggccgaggccccgatcgggatgccccacagcccgtcgacgctgagatagatctgctcgatcacctgatcgatcgggtagccgcgatgccagaacgggtaaggcagatggggccccgcctgggtgtagatcaggaagatcaggctgaggatgaccatcggccagcccagcagccgccgtgtcgcctccagcgtcgccaccacgaccacccagcccaggatctcctgcgatggggtgaccggcgtgacatagagcatccgcgaggcgatgccataggcgtcgatgacgacatagcccgcaggaaccaggatcgcgcagagaaagacgagatcgatgacgatctggcgcggccggcgggtttccgtggcagagatcgtacccaggcagaacaggaccgcaatgccgagcatgaaatgcgtggcacggtgggcctcggtgatcggcgggccgaccaccgccaccaccagatggtaggccgagagggccagtgccagaacggcggcaagcctgcgcatcaggaccgcgatccgccaccagatcccggtcggatgaggagcagtgcgtgccggctggatggcctccggagtgctgtcgttggggtgcatgtgacctgacctgaaggcggcattgtggagcgaacggcgccgctccacctgtctcgagcggcgggcgcctatttgattgcgcccgtctcgttgattgcgcccgtctcgcggtaatatttctccgcccccggatgcagatgaccacccgcgacattggccagatcggacaccgtcagatcctggaaagatccatggaccttcttcagtgcctccagattctcagtcagggtttttgcgatccagtaggcctcgccatccggcatgtcatcggccgccacgaccaccatctgcgcgctgacggtcgcaacgtcggaatcctgccccgcgtaaacgccgccgccgatcacggcacggccgagcgtcggcatgtcgctcttcagctttgcaaaggctgcgtcatccaccggaagaagcctcagcggcaccgtgttcgcaagctcattgccccagctggagggataggaagcgaccgagatcatcccctcgacgcggccatccttcatcgcatcggtctgctcgttgagatcacccgaggacagcctgaggtcgcccgagccgaggccgacggatttcagtgccgcctcgaagacgatcgccgagatggtgccgggacgctgggtcatgaaggaccggccggcaagatcgccgagcgcggcgataccggcatcctgccggacgaagacatgcatcagcgaactggacaggccggcgacgacgcgcacgttccggatcggttcaggaaacggcggctggccgcgggctgcgaccgtcagtgccggtgcgaccgtgaagcccagttcgcccttgtgatagccgacattggcgacgttggagagcccggcccccagctccggattggccggcacgccgtttttcgcgaagatctcggccatgccggcaccgataccgtaccagctgctgccggagacggaggtgaagatcgtgagattgcggggtttgtcttcggcgtgcagcggcaccgtggtcgcaaaacatgccgtgaccgcgagtgtcgcaatgcgacaggtcgcgagaagttggttgcggtccatgtcagtctccctggccttcgggctccctggcctccggcccctggtttctggtttcccggttcttatcttctggtcttcttgagaggattccggtcttcttatgatgaggctcagctggccgcgaggtgccgctccgccggcaaagcgctggccggacagccgaggcggagggaaatctcccgagcagcctcgacgatcttcagcgtcagctcgtcgaaccggaccccggtctgaagggtcggcgcataggcggcactgatcgcgccggcgatctgaccgttcgagcctcggaccacggcgccgaccgaatcgataccggtcaggttttcgccgatcgcggtcgcatagccctgacgccgtatctcgtgcaggtgttcgagcagagcatcctcggccgtgatggtacggtcggtgaactgtggcaggggccgggcgcggatcagcgacagggcccggccttccggcagttcggcgaggatcgccttgcccagcgccgtagaatgcagggcgagcggctgccccgtccgggaattgatcgagatcggcccctggctctgcagggacagcaggtagacgacctgatcaccgaggagagaccccaggaagctgttgacctccatcgcctgggtcagcgcctgcagaacctccatcgaggacgaaacgaggcggttgtcgttcagcagcgaggtgccgagcgacaatgccttatagcccagcgaatagcggttgcgctccgtatcgcgggcaagaaagccctcttccaggagcgtgttcaccaatcgctgcgtggtcgcgggattgaggtccagccggcggccgatttcacggacccccaggctttccgcggcccgttccagctccgacaggatcgccagacctctctgcagggattgattgccgttgctcaaagacgtgtgtccttctcatgcactgcgcccgggcggcctcagccgaggcggatcaggtcgcgggggatggtcgtgatcggctcgtggccctcccgggttaccaggatggtgtcctcgatcatcattccaccccagccgatccggtaatacggcgtctccacgcaaaggcacatgccggcctccagccggtccttcgtctgcggggtcagaaccggcatgtcgtagccaccgccgaggccgatgccatggccgacatgctggcggcgataggacggaatgccgttctcgcggacgacccggaccgtttcgtcgaacagcccggccacgtccacgccctcgcggatgacctccagctcgtagtcgataccggccctgatcgcggcatagcagcggacctgctccgcatccggctcgccgaagacgaaggtgcgcgccatgtccgaggcatagccctgatagatgcagccggcgtcgatccggatcaggtcgcccggtgccacgcggcgagccgtcgcataggcatccgccagtgccgagcgcggaccggacgtcacgctgacgaagcgcgggatggcgccgccggcgaccatcccggcggcaatgatcgccgccatgtcctgttcggtcatgccgggggcgaactggcgggcgacatcgagcaggccggtctcgaccagacgggtcgcctgacggacccgcgccacctcacccggcagcttgtggcgccgtgcccgggtgatggcatcggtgatgtcggtcaggaaccgggtcttcatgccctgcgcgatcacgttccaggcccgatcgtcgcccgaccggtcgatcccgatggtccgggcatcacccgccacctcgcggagtgccgcaagcagcgcctcgtcgaacgacgcaaatccggccgcgtcatagccgtcggcaccggtgccgtcgacctgttcgaaacagaagaagccatagcggaacagagcggccggatcgccggtctcttccagggcaggtcctgcatccgatgcgctgaccaccagggccaccctgtccctggtggcgacgaccgcactcaggtaccgcgggttgaggtcgtggacgatgctgaaatagccgctgagataacccttatgcgctgcgtgacaggacaccagcacatcgacggcatcccccaccagggcgaagcatttggcccgcacctctgcggccagcgccatgctgccggcaacctgcgtcgcccgatccgcacgatgcgctcccatcgtcgcgttcatctcacctcctttgttcctataatcgatctatcgtttcatttatcgtgtcaccctagcctcgccattccggagctgtcaagcgcccgcttcagaagggtcaggggcggggaaggacgacacccctcagacgcggttctgcccgggcctgcgaatgcagacccgggcagaaccggcgatgatcaatcgatggagtcggcgcccgacagcagaggggaaggctcagctgcgcctcaacaggcgcagcgcattggcggtgaccagcacggtggcgccggtgtcggccaggatcgccggccacatgccggtcagcccggcgatggtggtgaccaggaaaaccagtttcaggccgatggcgatcgcgacattctgacggatcacgcccatggtccggcgcgcgaggtcgatcagcgccggcacgccggtgacgcggtcgtcgagcagagccgcatcagcggtttccagcgccacatcggtgccgccgcccatggcgatgccgaccgaggccgccgccagcgccggggcgtcgttgatgccatcgccgagtttggcgaccgggccgcggccggaacgggtcagatcctgcacgatccgggccttgtcttcaggcatcagcccgccatggccctcgataccgagacgccgggccatcgccgacgcggtggccggggtgtcgccggtcagcatcaccgcgccgatgccgcggcgcttcagggcggccagcccgtccagcgcatcgccgcgcggggcatcctccatcgcgatcaggcccagcggccggccggtctcggtcaacaccgcgatgctgtggccggcctcacccgcgcgcgcaatcgccgcggccaggcccgcatcatcctgtcggcggccactgccgagcagaagactgcgtccctcgaccaccccgctcaacccctcccccgggatcgcacgaacatcgcgcgccggcggcagggtcaggtcgcgggtgccggcctcatccaggatcgcacgggcgatcggatgggcggcgccggtctccagcgccgccgccaggcgcacgacctcgtcggccgcaagggtgccgaagccttcgaccgtcaccacccgcggccggccctcggtcagggtgccggtcttgtcgaaggcgacggtgcggatggccgccagcttttccagcaccgcgccgcccttgatcagcaggccccggcgggcgccggcagccagccccgaggcgatcgccgccggggtggagatgaccagcgcgcagggacaggcgatcagcagcaaagcgaggccgcgatagatccagaccgaccactcggccccgccaagcagcggcggcagcacggcagtcgcaagtgccagccccaccgcgatcggcatgtagatgcgcgcgaaccggtcgatgaaccgggcgaccggggccttggcctcctgcgcctcttccaccagccgcaccacccgggcgatggtgttgtcggccgcagccgccgtgacctcgacggtgatcgcgcggtcctgaacgacggtgccggcgaagacgtcgtcgccggtcagcttctcgcgcgggaccgattcgccgttgaccgggctttcatcgatcagggccgcgccctcgacgacggtgccgtcggccggcacccggtcgcccgggcggaccagaacccgctcgcccacggcaagctctgccgcgggcacctcgcgcacgctgccgtcggcagcaacccgccgtgccgtacgcggcaccagatcggccagcgccttgatgcccttgcgtgcccgggcggcggcaacgccttccagcagttcgcccaccgcgaacaggaagaccaccgtcgcggcttcgccggcagccccgatcgccagcgcgccgagcgccgcgatggtcatcagcatctcgatggtcagaacggatccgccgcgcgccgcgcgaaacgcctggcgcgcaaccggcgccagcccgatcagcgccgcgatcacgaagggccagggatcggccaccggccaggtcacctccagcaccatcgccaccgccagcatcagcccggcgatgccgaccagccgcgccttgggggtctgccaccaggggccatcgatcgcggcgccgtgggcgtgatcatggccggtaccgtcaccatgatcgtgaccgtgatcatggccacagcccgccgtcggcgcaccgccgatggtgtagccgagcgccgtgatcgccgcctctaccgccggccgctccgggggcgtggcgccggccggcgtgtcgacgcgcaccgtgccgccggtcacgttgacgctgacctcggacgctggtgcgaccctgccgaccgcccgctcgatcttgagcgcgcaggaggcgcagtccatgccgccgaccgccaggcggagcacgggggcggcaccgccttcgatggcggcttcggggtcgtgagggctggcacgtcgcatcgcagggcctcgcagttcggggggaacgtccttggatgcccccgatcctgagacctacagcgactgtagcttcaagcccttttttgcgaaccggtcgcaccccacatatccaacagcattcccgaggggagacccggcatgaccggcggcagggcagcggccctttccatcggatccctggcgcgcgagaccggcgccaaggtccagaccatccgctattacgagcagatcggcctgctgccggaaccggcgcgcaccgccggcaatcagcgggtctatggcaagagccatcgcgaccggctggccttcatccgccatgcccgcgaactgggcttcccgctggatgcgatccgcgaactgctctcgctttcggacgatccggccgccccctgtgcgaccgccgaccatatcgcccgcgatcagctggcggcggtggaagcgcgcatccgccggctggaggcgctgaagatcgaactcgaacgcatgctctgcgatcatgcccgcaccggcacgatcgccgattgccgggtgatcgaggtgctggccgatcacagtcacgggcattgtgtggtccaccatgaagcacccgaggccgcatctgacctgacggacacaccgacgacggtgaaaacttcgtgagacatcaggaagcccgcgtcagaggcgtgggagtgtgctatccaaaaagcgtcgggccggatgaagaggccgaaggacaaaaggcggacgggacgggcgggcatggtgacgttttcgatgaagcgggcgggctgtgcggagcatcgccggaccgcacgtggccggggcagcgattttgtcgccttctttcgcgcctggatgggcgatccgctccgggtcgcctcggtcatgccctcgggcgaagggctggcgcggctgatcacgtctgaagtgacgcctgcaaccggtccggtcctggaactcggccccggcaccggtgttttcacccgggccctgctggcgcgcggcgtggccgaacgcgacctgaccctgatcgaattcggcgccgaatttgccggcatgctgacccggcgtttccccgaggcccgcatcgtacaggccgatgcggcgaagctgaagcagtgccggctgtatgacggtgccctggccggcgctgtgatcagcggcctgccggtgctgtcgatgcccgcccgcaaggtgatggcgatcctgaccggcgccttcggctatctgaagccgggcggcgccttctatcagttcacctacgggccgcgctgcccgatttcgcgccggattctggaccggctggggctgaaggcggtcaagatcggctccacccgccgcaatctgccgccggcctcggtctatcggatcacccggcggccggcgctgaaatcagcggttgcggcctgatacctgccgcgccaactgggcccccaccacctgcgcccgatgcagcgccccgccggtgaccgcaccgtcggtggcggtggtcgaggcataggagagggcgagcccgtcggccgcccgaaccgccagcaccgcgaaggcctgggcttcaagcgcatcgccgtcgaggccgacctcgtccaccggtgcaaccggcaggttggaccgcgcggcgatggcggcgcgcaaggtgcggttgtggcggccgccacccgccagcagcacccgttccggcggttcggcaccggccgcgaccgccaggctgaggccgcgggcgaccgcgcgggcggtgaactgcgtcagcgtggccgccgcatcggccagcggcagatccgcgaccaggtcgagtgccgcggcgaagcggtcgcgatcgagcgatttgggcggtgaccggtcgaagaagggatcggcaagcagccggtcgaggatcgcctcgtcggcatggccgcccgccgcggtgccgccatcctgatcgaaggcctggccggtgcggcggcgcatcagatcgtcgatcaacgcgccgcccggcccgcaatcgaaggcgagcagcccgccatcggcgccgatgaaggtgagattggcgacgccgccgatgttcagcaccgcgaccggcggcatcacccccgcccaggccatcatcgcccggtgaaccaccggcaccagcggcgcgccctccccgccccgggccatgtcggcgcggcggaaatccgagaccgtgtcgatgccggtcagggcggcgagccttgcgccgtcggccagctgcacggtgatgccctcgtccggcagatgcagcacggtctggccatgaaagccgatcagccggacatggggcgcgatctccggcaccgtttccagcagcgcggtcacggcgtcggcctgggcgcgggtcaacgccgcctcggcccgggcggcatcgacgagcggcgcccggccgcccagcagccgggacagcgcctcgcgcagatccgccggatagggccggaacagggtcggcccgaagccggtgatgtcaaccccgtcggtctcgaccagcgcggcatcgatgccgtcgagcgaggtgccgctcatcaaccccaccgcccagaccggccggcggcgcggcgcgccgtcatcggcagaggcggcaatgacggtggggtcgggatcggccggcaccggccggccggccatgcgggctgcgatggcgaccagcgatggcggtgcggggaagcccagcgcacgggcgcgcgaccagtcctgtgccgccggccagccggtgacggcggccgtgggcgccgcctcgggcgcgatggtgatcaatcccgccgcctctggccccgcgacgcgggcaacggcaccgaccagatcccccgcccgtatggtgcgtgcgggcagggccaccagcgggtcgccgcccagcgccgccgccggcagaccggccagccggatcagcccgtccacggtagaggcgacatcggaaaccgcaagcttcacccccgccggcagcggcagcaccaccgcctctccggcaggtgccgccgacagcacccgggccaggcgggcgaccgcgctggtgccgccggcggcggccggccggtcgatgatgctggcgatgcgggcgatgcgcggatcgaccacgccgcggcggccggcatcggcgagcagcagctcggccgcagccttggtcgcgccataggtggtggccgggcgcggcgcatcgtcgtcgcctgcgctcgcccgcgccgtccgcccgccatggaccgagatggtcgaggcgaagaccagccgcgtctgccgcccgcttgcggcgatcgccccgatcagatgacgcacggcatcgagattgagggcggccgcggcctcagggtcggcctcgcccgagggcgtgttgccggcggccagatggaagatcagatcggcccccgcgccgatcagcgcgcgcactgcatcggcgcgggtcagatcgacggcaggcgcgccgccgcgggcgacctcgtccagccgctcgatcggccgggcggcgccgtcgatcaggatcgtgcccgccgccttcagctgcccgaccagcgcccggccgatgaagccagtcgccccggtcacgatgatgcgcatcggtcacgtccctccgagactgcgttgatctgcctgaccacggatcgtcatcccgcggccggtcatctggcggcccgtcatctggcggtgcgggcggtttcgtgctacatccgcccgcgtatccaaacccggtcggccccctgaacgatccacggccggccgctttcgtgcaagaggaaccctgccgatgaccgatcgccgctacgtgtccgacttcgtgcgcgtaatggtcgagcgcggctatctccaccaggcaaccgacctggaggggctcgacgagcgcttgaaccagggcacggtcgccggctatatcggcttcgactgcacggcgaaaagcctgcatgtcggcagcctggtgcagatcatgatgctgcgctggctgcagaagaccggccacaagccgatcgtgctgctgggtggcggcaccacccggatcggcgatccgaccggccgcgacgaggcccgcaagatgctcgacgatgccgccatcgccgagaacatggccggcatccgccaggtcttcgacaagttcgtgcagttcggcgacggcgccaccgatgcggtgatggtcaacaacgccgactggctggacgggctgggctacatctcgttcctgcgcgactatggccggcacttctcggtcaaccgcatgctgaccttcgagtcggtcaagctgcggctggagcgcgagcagccgatgtcgttcctggaattcaactacatgatcctccaggcctacgacttcctggaactgtcgcgccggcagaactgcctgctgcagatgggcggctcggaccagtggggcaacatcatcaacggcgtggagctgggccgacgggtggacgagcgcggcctgttcggcctgacctcgccgctgatcaccctcgcctcgggccagaagatgggcaaaaccgcgggcggtgcggtgtggctgaacgccgagatgctgtcggcctatgactactggcagttctggcgcaacaccgccgatgccgatgtcggccgcttcctgaagctgttcaccgaactgccgctggacgaaatcgcccggctggaagcgctgggcggcgccgagatcaacgaggccaagaagatcctggcccatgaggcgacgaagatggcgcatggcgaagaggcggcgctctccgccgccgaaaccgcccgccgcacgtttgaggaaggcgccgccggcgaggatctgccggtgatcgtcatccccgccgcggaactggatgccggcatcccggccttcgaactcttcgcccgcgccggcctcgcccccagccgcaaggaagcccgccgcaccatccagggcggcggcgcccgcctcaatggcgagaagatcgaggacgaacagcagccgatcaccacggcccggctggttgacggccagatcaagctgtcggccggccgcaagcgccacgcgctggtgaaggtcggctgagccgcaccggacaagcggtcgggacgaaatacgggcggcaccggtcggggccgcccgtttccttataggcgacgtccggtgttacgacgccgcctcaaacgccgcaccgatctccagcatcacctcgtccgagaccatcggcacgatataggtcatgccgaaatcgctgcggcggatggtggtctccgcctcgaagccgatggtggcggcctggttcatggggttgacgccggcgccggtgaagcgggcgtcgagcaccaccggcttcgtgacgccgcggatggtgaggtcgccggcgatcttcgccgtcatgccgtccacctcgaccgcggtggagcggaaggtgatggtggggtgggacgccatgtcgaagaaatcggggctccggagatgctcgtccagctccgcgctggtggtgaccaggccgtcgaccgggatctccatcgccacgctggccttcgacgggtcggccggatcgatctgaagcgtgccggtggcgccgccggcaatgccgcgataggcgttgaagccgaaatggtcgaccgtgaaggtgatctgggtatgggagggatcggccgtgtagcggcccgcggccacccgtgacggatcggccgcacccggcacctgctgcgccatggcggggacggcaacggcgccgaggcccaggccggcgccgaggatcgcggcggagagaacggtcttcatcatcggcggcatccgatcatcctttcgaaaccggtagacggcatatccgtcccgcagtctttcacatccgtcgtgaccattgcgtgttcgcgaaggcgtgacaccccgcacagccctgcccggcctgcaaagccgccccgcaaccgcgggacttgcacgggcggccgatccggcataaatgtcgccagacaatcattagcagcctatatatgtggtccctatgaaatcccgccccgccaccctgcgctccgacgtcaccaacgagctggccaccgccagccgcaagatgcgcaccggcttcgatgcgctggtccgcacccgcgggctgacgctggcccgggcacgggcgctgatgctgctggcccgccatccggggatcagccagaccgagctggccgggctgctggaaatcgagaacccgaccgtggtccgcctgctcgacgggctggagaaacaggggctgatccggcggacgcccgccgagaccgaccggcgggtgaagcggatcgatctgaccgaagcggccgaagaccaggtcgacgagatcgaggatctggccgaggtgatgcgcggcaccatggcgcgcggcattcccgaggccgatctgaccgtcaccctgaacgtgctgcgccggatgatcgccaatctggagagcggccccgccgccgatgacggggaggcggattgaggtgaccgaggagcccggcatccccatccggcggatgatcgcctgcatcgcaacctcggccctgctctggtcggcgcagggcctgggcatgaacctgattgccgccaacaccacacagatctcgggcgcgctcggcgccaccaccaacgagacgatgtggctggtggcggcctatatggcgcccaatgtcagcctgaccatgctgctgaccaaggtgcgcaaccagttcggcctgaggcgcttcaccgaaatcggcatcgcactcttcgtcgccgtgtcgtgcctgcacctcttcgtccaggacctgcatgccgccctggtggtgcgcttcctggccggggtcgccgcctcgcccatgtcgacgctcggcttcctttatatgctggaggccttcccgcaatcgaagaagctgtcctgggggctcagcctcgcgctcacctgcaccacgctcagcgcgccgctcgcccggatcatctcacccaccctgctcgacctcggcctctggcacgggctttatctgatggaggcgggggtcgccctgatcgccatggccgccgtgcaccggctgccgctgacgccgatcccgcatacgaagatgctccacccgctggatgccgtcagctatccgctggtcgcgaccggcttcggcctgctggcggtggtgatggtgatgggccgctatgaatggtggctggaggcgcggtggatcgggatctgcctcgccctttccgccctttgcatcgctgtcgcggccgcgatcgagatccatcgcgaaacgccgctgctcaacatccgctggctgaccagccccgagatcctgcatgtggcggccatcctgctggtctttcggctggtgctgtcggaacagacctcgggcgccttcggcctgttccagacgctgggcctgctcaacgatcagagccggtccctgcaggtcgtgatcctgctggcctcgatcgcgggcgggatcacctgcgggatgctgctgaagccggggcgcgacgccgcctttcacgcggtcgccctgctctgcatcatggccggcgccttcatggacggtcatgcgaccagcctgacccgcccgggccagatgtatctgagccaggcgctgatcgccttcgggggcatgctgttcctgccgccggccatgctgaccgggctgatgcacaccctgaaacaggggccgaccttcatcaccagcttcatcgccgtcttcctgttcactcaaagcctgggcgggctgatgggttcggcgctgttcggcagcttcgtcacgcttcgcgagaagttccattcggcccggctggtcgaggatgtggtgctgaccgatccgctggtcgcggcgcgcgtgaagcagctgggcggcgcctatggtcatgtgctgaccgatcctgccctgaccaatgcggaaggcatcgccctgctcgcaaaacaggcgacgcgcgaggcgacggtgctcgcctataacgacgccttcctcgccatttcggccctggcagccctggcgcttgccggccttgtcctccatctgctcgtcgcccgggtccaccggacggcggatgcgatcgcttcctgatgtccccatggccaagaaaatcttccatttcaagaccctgatcatcctcgccgccggccttgcaggtgcgctgctcgtcctttacgcctggcggctgccgcccttcgacagcggcgtcgaggtcaccgagaatgcctatatccgcggccgggtcaccctgctcgccccccagctttcgggctatgtgacggatatcgcggtcagggatttcgagacggtccgggccggtcaggtgctggtgcggatcgacgaccggatctatgcccgccggctggagcaggccgaggcggagctggccggcaggcaggccgcgctggccaatgccgatcaggaccggcttgccgccgaggcgcgcatcgcctcggcgaaggcggcggtcgacagcgcgcaggcggccctcacccgcagccgcgccgatgcgggccgggtggatgcgttgatcacccgcggcgccgcaacacgcgccgcggctgatgccgcccatgccgcccgcgaccaggcggccgccgccctcgcccaggcagaggcggcggtggaggtggcgaaacaggatctccagagcgtgatcgtcggccgcggcacgctggacgcggcggtggaagcggcacgcgcggcggtgcggctggcgcggatcgacctcgacaatacccggatcacggcgccggtcgacgggcggatgggcgagatcggcgtccggctcggccagtatgtcacggccggcacccagctggcggcgatcgtgccggccgatcgctggatcatcgccaatttcaaggaaacccagctcagcggcatgcggcccggtcagccggtctcgttcaccgtcgatgccctgcccggccagagcttccgggggcggatcgagcgcttctcccccgccaccggctcggaattcgcggtgctgaagcccgacaacgccaccggcaacttcaccaaggtagcgcagcgcctgccggtccggatcgcgatcgaccacgaccagccggcgctggacggcctggcaccggggctgtcggtggtggtgcgggtcgacaccgaaggcggtgccggccgcggctgatcggccatcaacgattgaagtccggcttgggatcggtaccggtcggcgggctgccggcattgcctgtcaccccgtcggcgatggcgccgaacaggttgcgcagaaagcccggcgccagggcggcgagcgggttgacgctgacatccgggtcgtcgagcggccccttcagtcgataggtggcggcgaagatgccgctgccctcctcccccaccagcagatcgccgatcaccggaatgcggccgatggcgctgttcagggtatagagcggcaccagcgtgccggccatgtcgatggtgccgccgtcgatatcgatctgtcccgaagccgtgacgccgacctcgctgccatgggcccgggcctcggcgagcgtgacgaccccgtcctcgtagacgaaatcgccgtcgagcacgctgaaggcgatgccatcacgcccgcccagctggtccgagacaccggccggcgaggccgtcgccagggcgcgggcgatggcgggcgcgttctgcaggcgatagtcgcggccgaccacatggccgcggatcagatcatgggcgacgctgtcgtcgatcaccccgtcgatcaccatcgatccgccggcgatgcggccgcgcagcccggcaaaggctatgagatcatccatccggtcggtctccagccggatggtccgaccaccgacggcggcggcaccgccaccgatcgcgaccgacaccatgcccggcccgcgattgccggcagccgccgcggtttccggcgccaccggcagcaccgcctgcagccgcgcctcgcgccagtggccgttcgcgatcgagaccgagccgcgggcccgatccagatgccgttcatcgtcgatccgcacccgatcgagcgccagttccagatcgatccgcttcggcggcgcggccggatcgcgaacctcggcggccgtctcgccgcccttgcggtcgatcagcggttcgacatcgagcatccgcccggccagcgacacccggtcggccgcaccgtcgcgaccggcgcgataatcgatccgcagccggctgtcgccaagatccagacgcgtgatcttcgcctccagcagccggcccgccgccaccctgagcgtgccgagcgaatagagatcgcccgcctcgatccgcagatcgcggatatcgatgacttcaccgcccggacccgcaccgcccggcacggcgtgggggtggaccgtggccgtcagctgcccagcggttccggcgggcttggtccagccgatatcggggatggcgaggcgcgaccgggccagatcggcatcgacctggatgaccggctcgtcgggcttgccgcgcggcacctcgaccgcaagcttcaggccgatcgggccggtcagataggggtccaggtcgaagccggcgcgcttgcgggccgcctcgtccagcgtgcccgcgacatccacccgccgctcccactcggtgggggcggcaatcgcctgccgccagtcgatgtcgagcggcgcgccgccgatcgccgcccggccggtcagccgcgcctgggcattgtcgaccgccaccgcgaaactgccatcggccatgtcgagcccgagcaccgccttgcgcagcgccagcgcctcgatccggccgcgggcggtatagcggacatcgggcttgtcctggccgagcggcaatttgagggtgagatcgatatccgtgcgcccctccagcccgtcggggttggacagggccgggtcgacgaattcgatcggcggcatggcgagcacgcggaccgcatcggcgaccgggcccgaaatcgggatcatcgactcgacccttgtcggctcggtcttgacgccgaagccttcgatggcgacccgggccgccccgagacggagcccggtatcaccggcacggccgccatccttcagattgaagcgcaggccgcggagatcgaaactgccggtaccggccagatcgcgcgccggcggcagcggccgttcataatcgaccgagatgccccgataggcgaaatcgccctgaatggccgagggtgccagatgcccgtctgcgcccagcatgcccgggcggatgtcgagcaccaccgacacgccgtcgacccggccgccgcgcacccgcgaaatcacccagtcgcgcgccgcctcctgctggccgagcggccagtagcggtcgatatcgtcgacggcgagatcgccgccgatcaccccgcccgagatgccgagccccgcggccgggccgttgaggccggtgacggtgacgctgccgccgagtgcagcaccgtcggccaggcggagatcggcgcgggtgacttccaggcggttgccgtcttcggtgagatcggccgcaagcacgacccgctccaccggcagcggccgggcaatgacgccgggccagtcgacctctcccgcccccgccgtggcatggagccgcagccgatcgatccgacgatcggccatcttcatctccaccaccccctgcagcggcaaagcgaggccgtcgaagggggccggcaggccgagcacggccgcgatccggtcgacgcgggtgggatggatggtcaggtccagatcggccgcgccctgatcgggggtcaccaggccgcccagcgaggcgccgaccgcctcgcccgcaacattgccggccagatcgacggcgaccctgatccgctccccctcgcggatcaggcgcagatcgcggccggagatctggcccgaaaagccggcgacgccgtcctgataggtgacgtccaccgctgccacgcggaccagctgcacccgggtcatatccagcgcccaggcgccggggtcggtcatctggttgagccagccacgcagccggtcgacatccgaagcgggttcggccggtatcggcggcgcggccggatcgggcgcgcggagttcgtgatccggtgccttgggttcaggcggtggtgcaccgggttcgaacagcggcatcagccgcgagaccggcaacccgtcttcgggcgcccgggcacgttcgagcggggccgcatcgagcagcgccagcgaaacctcgcccgaaggcgcgcgctggacggccagttcgactccggtcacctccagcaccgtgggcgcgatgcgctgggcgatcagatcgccgaccgacagcccgatccggaggccaggcaggcgcagtaccggctggttgaaccggtcgatgatccggacgtcttcgaccgccagggtgagggcgacattggtggcgtcgagcgagagccgggcctcgccggcatcgatccggaagcggccctcggccagttccagccggtcggcgatccacggcccggccggccccagatcgaccggccccgcggccagccggaagcccgcagccgccagcgccagaatgacgaccagcagcagcccgagcacaagacggacgacccaggtcgagatcctgacgatcatgcgggcgcgtccttactgtcctgatgggccggcggcaggcggcagtggaggcgatgcgccgggtcttgcgtcccggcaggggttatgatccggtgtctagcaggtaatgccgatcgcgcgaagcgccaagacggtgtccgtcgcatggtcgcatggcctgcttgcgtgatcattacgtgtcatccctgccccatctccgcgccccccacgctgcgccccgtaccggaagcccccgcatgaccgccgcttcgcccctgctcgacgccgccccgggccatcgcctgccggtcgtggccgaccccgaccgcgccgcgatcgcccgcgagcgcatcctggaacggctgggcgaggcgcaaggcaatgcggcggacgacctggccgcctttcgcgcgtttctggaagatccggccggccggcggctggtcgacggcatggcctgcggcagcgcctacctgacccagctggcggtgatcgaggcaccggttctggcgcgcaccgtgcgccttggccccgtggcggccttcgacgagatccgcgcgggtttcgaggcgctgaaacgccagggcggcaccgaggcgcaggtgatggcagagctgcgccggctgaaacggcgggcggcgctggtgatcgggctggccgatctggccgggatctggtcgctggccgatgtgaccggcgccgtttccgacaccgccgaagcggcgcttcaggcggccttcgcccatctgctgcgcgatgcggccaggcgcggcgagatccggctggacacccccgaggatcccgggccgacgagcgggcttttcgcgctgggcatgggcaagttcggcgcctgcgagctgaactattcctcggatatcgacctgatcgtgctctacgagcccgagcgggtgcagatggccgacgaccgccacccccagccggttttcacccgcatcgcccgcgatctggtgaagctgatggaggcgcgcaccgccgaaggctacgtcttccgcaccgatctgcgcctgcgcccggacccggcctccacgccgcttgcgctctcggccgaagcggccgaggtctattacgaaagcgtcggccagaactgggaacgggcggcgatgatcaaggcccgggttgtggcgggagatcagaccgcgggtgagctgttcctgaaacggctgacgcccttcgtctggcgcaagagcctggatttctatgccatcgccgacatccattcgatcaagcgccagatcaatgcccatcgctcgggcgacgggctggacctgcccggccacaatctgaagctcggccgcggcggcatccgtgagatcgaattcttctgccagacccagcagctgatcttcggcggccgctcgcctgcgctgagagcgcgcgcgaccgaggcggcgctggatgcgctggtcgccgaacagcgggtggaggcgccggtggcggcgcggctgaagaccgcctaccggctgctgcgcaccgtcgagcaccggctgcagatggtcgacgacgcccagacccattccctgcccaaagacgaggccgccttcgcccgcctggcggcgttttcaggcttcgaagacccggccgaattcggccgggtgctgctcgacacgctgaagggagtggagaaggcgtatgcggaactgttcgacgacgcgccggggcttggcaccgccgagggcaacctggtcttcaccggcaccgaggacgaccccgacacgatcgagaccctggagcggatgggctatcgcgagccgtcgcgcgtggtcgcccgcgtgcgcgaatggcatcgcggccgggtccgcgccacccgcagcggccgtgcccgccagatcctgaccgagatcatgccggaactgctctcccgcctgggcgggaccggcgatcccgatgcggccttcatgcgcttcgacgccttcctgggcgaactgccctcgggcgtgcagatcttcgccctgttccacagcaaccccgaactgctggaactggtggcggaagccatgggcacggcgcccaaactatcggaacagctcgcccgccggccgtcgctgctggaagccgtgctcgaccccgatttcttttcggaactggcgacgcccgaggcgctggccgccgatctggagcgggtgctgtcgcgggcgatcgactatgaagacacgctggacctcacccgccgctgggcgggggagcgcaagttccaggtgggggtgcacatcctgcgcgggctgaccgatgccgatgccgcagccccggtgctgaccgccatcgccgacgcggtgatcggcgccctgctgccgcgggtgctggacgaattcgcccaggcccatggccggatgcccggcggacggatcgcgatcctggctcaggggcggctgggatcgcgggagatgtcgatcgacagcgacctggatctggtcatcgtctacgacgcctcgggcgaggccggatcggatggcagccggccgctggggccctcgcactactatgcccgccttgcccagcgtttcatctcggcgatctcggcgctgaccggggaaggccggctttacgaaatcgacacccggctcaggccctcgggctcgtcggggccggtggcgagccatctggatgcctttcgccgctatcaccgcgaggatgcctggacctgggaacatatggcgctgacccgcgcccgggtggtggcggccagcgacgacagcctgaggcaggatctgaaccaggtggtgcgcgaggtactgctcaccccccgcgatgccgaccgggtggtggtcgaagtggcggatatgcgccgccggatcgcccaggaacacggcaccgaggattgctggcaggtcaaacacgtccgcggcgggctggtcgatctggaatttctggcccagcagctgcaactgatccacgggccggacatgcccgggctgctgctgggcgacacagccctggtgctggcccgggcggaggagctgggactgatcgaggatggcgcgatgcttgccgatgcggtaaggcttcagcggcgcatgctgggcctgctccggctgaccgtcaccggccgcttcgacggccggacggcgcccccggggctgatcgccgccctcgcccgggccgcgcgcctcgacgagggcgcggatgccgaggcgatcggtgacgtgctccgctcttgccaggcgcgcgtgcacgcccatttcgaccgctacgtcaccgatgtcgccgcccgggtgaaagccgaaggcgcggcggatgccggggcggaccccaagatggagacgaaacgatgatcgaggaaggcgccaaggccccggatttcaccatgcccaccgatggcggcggcgaggtgtcgctggccgccctcgccggcaagacggtggtgctctatttctacccgcgcgacgacacgcccggctgcaccaaggaggcctgcgccttccgcgatctgcatccggcgctggaaaagctggatgcggtggtgatcggcgtgtcgaaggacagcgtcgccgcccatgacaaattcaaggccaaatacgacctgaacttcccgctggcggccgataccgacggcgcggtctgcgaggcctatggcgtctgggtcgagaagaacatgtatggccgcaagtcgatgggcatcgagcgcagcaccttcctgatcgacggcaccggcaccgtgcggaagatctggcgcaaggtgaaggtcgacggccatgccgaggccgtgaaggcggccatcgacgcgctctgacgggtgacgcatcccgtgaccacagctgccttcatccccgccgccatcggggttctgctgaccgcggagccccgcgccaaggccgcctcggcgcgggcgctggcggcggactggcgagccggacgcctggctgccccgaccctggctgccccgaccacggccaccgcaacggataccggggcggcggcgctgccgctgcgcccggcccggccggagcgcccggttctgctgccgccgtcgcgcatgcccaagcgcggccgcggcggcaacgtcgccagccgggtgcggctgctgcatgcgctcgcccatatcgagttcaacgccatcgatctggcggtcgacatggcggcacgcttcggtgcggaaatcgatgcggacgagacggtgtgccggcgtttcgtcgacgactgggtcggcatcgccgacgacgaggcgcgccatttcggcctggtcgccgaccggctggaggcgctgggcgcggcctatggcgacctgcccgcccatgacgggctgtgggaggcggcgatggcgaccgcccatgacatgaccggccggctggcggttgtgccgatggtgctggaggcccgcggcctggacgtcacccccgacatgatccgccggctggacgagttcggcgacaccgcctcggccgacgcgctgcgcgtgatctatcgcgacgaggtcggccatgtggccgcggggctgcgctggctgacccatgtcgcgaccgcccgcggcaccaccgcacgggccctgttccacgaccgcgtccgccgcctgttcccgggccgggtgaaaccgcccttcaatgccgatgcccgcgcccgcgccggcatggtgccggaagattacgagccgctggcggagatgcgcgaccagacggcacatcccacgcccctggcctgagggccatcacatcacgacatcggacgatccggaccatgctcatccgcgacgcggctgccgccgacctgcccggcatccttgccatctataacgacgccgtggtcaacaccaccgcgatctggaacgagcgcctggcgacgctcgatgatcgcagccgctggctcgccgcacgccacgacgccggctatccggttctggtggtcgaagacggctcgatcgagggcggggttgccggctatgcgagcttcggcgactggcgacccttcgacggctatcgccacacggtcgagcattcggtctatgtccaccccgatgcccgcggccgcgggctgggccgcgctctgatggaggccctgatcgaccgggcgacccgggccggcaagcatgtgatggtggccggcatcgatgccggcaacaccgcctctctcgacctgcaccgccggctgggcttcaccgaaaccggccgcctgccgcaggtgggcgccaaattcggccgctggctggacctggtgttcatgcagcgccggctgtcggaacggggggtgccgccggagatgtgatcggcatctccggacacccgtgcagcgcaggagtctcttttcctgcaagggccaaatgacgatatcattggccaggatcactcccggccggaggaaaccaacatggggcatgtccgcagtattgccgccgcggaagcgcgcgatcacctggatgatctgcttgaagccgtcgctcagggcgaagaagttgccatcatgcgcgacggcagggtcatcgcccggctcatcggatgcccttccaaagaagccggaagcagagcacttgagggtgtggaacggatgatcgcgacacgcgccggtactacgctgggcggtgtcgccacgataaaggatctcatcgaagacggtcgtcgatgagcctggtgcttgacggatccgtcgttcttgcctggtgctttgacgacgaagtcacgccggcgatcgacgatctgatgcgtcatgttgcccgcaacggtgctgttgtccctgcgatatggcatctggaggtcgcaaacggtctgcgaaccgcactccgtaaacagcggctgacaaccggacggcgtgatgagctgatggacatactgaagcttcttcctattgaaccggataccgaaacggcccggacggcttgggagaagacccttcagctgtcggacaaacatggtctgacaccatatgatgccagttatgtcgagcttgcgctgcgaagagcgttgcccattgccacgttggaccaggcgatgtgtaacgccgcgcgtgcctgcagcgtggatgtgatcgggctttcatcccggtctgcgggcgtctgagccttttggggcgctacatgaccaccacctccatctccggctgcccggcatagtccaggcggatggcgccgcgggcggggcgggtcagggtgatggggccgggtttttcgtccaggcggcggcgaagcaggatcaggcgggtttccagattgtccttgaaatccggcaggcgcagggccgcatcgcggcggatttcacggttggtgaaatcctgacgcccggtcgccagataggccgtgacgaaatggtggagcagccggccgggcacgccgcggatcagatagtcgccgtcgatgaagatgctgccgtcgcgcgggaaatagcgcagccggatcgggcgccggcccgcgggcgccgggtcgggtgcctcggccgctggtgcctccccgcgctccgcctcggcccggtcgagggcgagggcgagcgttgcggccacgatcgacagcaccgcctcttccgcatggccgaaggcgaagctttcggccgattcggcgaaaagcacccccacaagccggccctgggcgatcatcggtaccgccagctggcattgcggctgcgccagggacggaaacggaatcccgatcacaggcggccggtccatcgcccccctgacggccgcgacatagcgctggccgcggcgcatgtcggcgatgcgcagcacccggcggcgcagggcggccacgccgatcaccccctcccccagcgccacttccgacccgacgccgaattgcggataaccacggctggcgatggtggtgagcaggccgccggtttcgtccggaaccgccaccaccagattgcccatgcccagatccgcaaccaggcgatcgagagtgagatcgagcagacggtcggcatcgggctccgccgccatcagggcggccaaccgggccgcgaccgccagatgatccggcgcttgcggccggggtggcggcgtctccagcggttccgccgccaccacccgggtcaccgcctccacccggtagagatcgaccgcgcgcaggcgcatcacctcgcccatgccctgggcggcgctcatcacctccagatggacggcgatgcgctcgaacacctcgcccgtggttcgggcaccgacgaagaccaggtcgagcaggaactggtcgccggtgcgggcatcgaccaccatcaccgtcgcccggcccgtgcggcggacattggccgcggtcttggaaaagaactggttcgacagcgcgacatggcccgcatccacatagtggacgtgggagagataggagatgtttggcatgccgtcggcatcgagggtggcgatgaccgaggggatgatgccttccagcgcatcgcgcagcgcatcaaggcccggcagcgcatcaaggcccaggccgacggtcatggctgcgcgtcccggggcgtgtttgcggcgccgagcggccggccggcagtcgggcccggggtctggtcgaagacttcgcgcggctgaatgtcgatgcgtagcagatcccggtcggtgagggtctgggacagctgaagccggctgacgccgagcgcccccatcacccccagcatgcgcgcgacataggccgtgccctcggccgcatcggccgggccggcgggcgcgacggccgtgatcatgcccttgatctgataggtgcggtagtcgtggggccgcgcacaggtgaccgcgatcggcccgccgtcgacggcgcccgaggccgcccccggccagaggctgcgcgacatcagcaccgcaagcccgttgcccttgtcccgcaggatccccgaaccgcgaccgatcgtggcccttccggccggatcccgggtcgagaccaggatcatcagcggcccggcgagcacggccgccacctcgtcgtcgatcatgcctccggccccctcccagatcacgcctccggccccctcccagatcatgcctcccgccccctcccacacgtctcccccgtctgatttttaggaaacggctgcggccgttagcaagcatttaggaagagccgttccagctgtcggcgtagaaacgcaaccacaggatgggccccgacagcaggggccgccccagaggaggacacctgatgaccatgatccacggcagccggtccgacgccgccatcaccccgatcctgccgctggacgggcggtacgatctttacggccccgtgcacaaggggctgcggcgggccggcatggccctgctcgaccggctgggccgggcggatttcgccagcccggccgcaaccaccggtctgctgaccgagctgcgcgactatctgcggctcgccaccgcccatatcgcccatgaaagcgacaccatccaccgggcgctggaggcccgcacggggcccgcgacccaggaactcgatcgccagcatgccgatcatcaccgctccatcaccgggctgatcgcaaggatcaccgcgctgaccgacgacttctccgggacccgcgaagaggccggccgtgcgctctatctggccttcgcggcccatctggcccgggatttcgcccatatgcacgaggaagagacggtgaccacgcccctgcttcaggccgtgttcagcgatgccgaactggccgcgatcgagatggagatcgtgagcacactgtcgcccgagatgaacctggccttcatgcggctgatcatcccggcactgtcgccggccgagcgggtgcggctgctgggcggcgtgcgtgctacggccccggccgaggtgttccggctgctgatggacgaggtcgcccggccgctgctgccgccggccgatttcgccgacctcgccctcaggctgcagatcgcggcctgacgctgcgctcccgctggaaggcggccgccaggatcgcggccatcatcaccaggatcgaaagcatcagccccgcccggatgccgtcggcgccatcggcgaccagaccgctcatcagcggcccgatgctctggcctgcggcaaagcccacggtcagaaagccgatggcatgggtccagccatgggggtcgacattgcgccgcacgcaggcggtcatcgccgccaccgcggccaggaaggcgccgccgaacagaatggcagagagccaggcggcgccacggctttcgaagaacagcgggatggcggcggcaagggtggtgacaccgatggtggcgacactgccccagccgccgcgaagccgcgccagcacgggcccccaggcgaaggccccgatcatggcggcgatgccgaccagcgcccagaagagcgagatttcccaggccaggaaatgctgggtgtcacgcagataggcgacgatataggtggcataggcgatgtagccgaggccgtagagagcgtagctgacgatctgcggtgccatgaaacggatcgaccagccgcggccggaactgcccgccggggccggccccggatgcggcgcgcgggcaagcgccggcgcggcgatcgccatcgccgcgaacgagagcaggccgagggcgaaccagcccgcctgccagccggccgcggccaccagcggcggcacaatcagggccgagaccaccacgcccaggccgccgccgccgaaatagatgcccagcaccagcggtgcccggccgggtcccccaccctgcccggccgcggcggcaatggcgctgccggcgatgaaggcgacggcaccggtggcgccgccgagcgtgcgcagcaccagcagcggcaccagcaacccggtcaaccccgagcagaacagggtcgccgcggtgatcagaccgccgatcatgaaggccctggcgccaccgatggcgcggatgaccggcgccgcgatcagcgcgccgatcacgaagccgagcccgcttgccgcattcatggcgccggcctcggtgaaactccagcccagatcgctgcgcatcgacggcagcagcagggcataggcgaaccggccgagcgccatgctgaccgccggcatcatggcaagccccgcagccacccggagcgacaccatggcaggcggggcggcttccacgctgtccgccgcccgcgatccaccggatgcgatcgggttttccgtcacctgtatctcccagaggatgatgggtgccggtcacccggcgacctcctgcgccgccggtcgccgcctgaggacgaccgaccccacataggatagtacgggttcttcatcctggttgaacatttcgaacagaaatctgccgatcccgcgatcccgggcatcggggatcggccgggtatcgatcaccgttacccggccaccgagcgtgtcgcccgggcggatcggtcggatccagcggacatcggcaaggccggccccgccgatgctacaggcgcggaacaggccgcggtcgatgaacagccggaagctgagggccagtgtatggaaaccgctcgcgaccagcccgcccatgggcgagcgggcggcagcctcgcggtccagatgaaagggctgcgggtcgaaacgcagcgcgaaatcgatgatctggctttcggtgacggtgatgcctgccagcgggaacacctcacccttggcgaaatcctcgaaataccggtccgcggccgccgtcatgccccgaccaccccgaagaccatctccaccggcgagaccacgccccgctggatgttggtgaagatgttgaccatctggcggacggccgtctggcccatcgggatgtgcagccccagcggcgatacgccttcggccgcggtacgggcctgaaggtcacggaaataggcaagaccgaagtcgcgacggtcgcgttccgagatcagcgtgaaaccggccgcttctgctgccgcccgatattccgcgggagacgaaacgaagctggtggtctcgatgctggcccaggggaccggataggcgatcgccccgtcggccgtgcgcatcacgtcgtagatcccgagccggccgcccggtttcagcacccgacggataccggcgaacagcccgggcttgtcggcgatgttcatgccgacatgcatgcaggtcacccggtcgaagctggtcggagcaaagggcagtgccgtggcactggcctcgcgatagtcgatccgtccgcccagtcccacccgctccgcaagggcttcggcggtccggacgaaatcgggggccagatcgatcgccgtcacccggcattgccgccgctcggcgaaatagcgcgaggcgccgcccagcccgcagccgatatcgagcagagccatgcccggcgcaaggcccagccggtcggccagatcgaccgtcgcctgccggccgccgacatggaattcatccaccggcgccagatcttcgaaagacagccgctccggatccttgccggcggcttccagcgccgcgacgatcttgccctccagcgccggacgggcgtaatgcgcggcgaaatcgctctcgaaactcatcgatacctcctcccttggtgccgtcgttccgcaccgtcactcggccgcctggagggcggcttcctcgatgatgaaatcggccagatgtcccgggctgcgaaacgggctgatccgccgcgataccgcccggtcggaggtcagcgtcaccggcagattgagccggtcggcgagtttctcctcgaccccgaccaggaaattgaccagttgaatggaatccagcaccccgccctcgccgtagagaacgatcccgtccagcgcatcgagcgggagcttctcgatccgggtctcgttgatctcggcgatggtttcgtcgatcacggcgacgatctggtccttgcttgccatcatgacacctcgttgagcgaaggaagggtccgcttcggccagccccgtttcggccagccccgtttcggccggccccgtttcagacaggctctccacccgggccaggtaatgagcggtgacctcgtgattggtcgaacgcaccgaggcgccgaagccctggcggaaacggaaccggaaacggtggcggccgacaccgggcggctcggtcagccggtcggcggtgcgggcccggtcgatcagggccggcgggtcgatgtcgtaatcccggatcacctgccagtgcgggatgtcgcctgcctcgtcctcgaaaacctcggggaagttgcggtgcgccgggtcgaccaggggccgggtctccagctcgaagcggatcagttcggccatggaccgccgccatcggggcggcaggcgatggtcgagcacctggcggcgccagtcctcgatcagcgcatcgaagcggcgatcggtgcagcagaattccagcgccggcgccagtgtgtcgggatcggcgaaggcggcatgggccgcctgacgcaggatctccgcacccgcggcgcgcgatgcctcgacatggccaccgatcgacaggatcgccgccgactggctcaaccccgccacggcccgcaacaccggccagaggccgcggaagaccaggttctcggccagaagccgcgcccagaacaggaagcgggtcatgcgcagatggtcgtgcagaccggcactgcggttggccaggatgtattcgaaatcgtcgcgctcgccccgcacggtgatgaagccgtgctcagcccgacgatcggtgaaatcggtattgggcagcagaagcaggggataggccgcgatccgggtgacgtggcgggcaagctcgtcataaccgcgcaggaaggatgccggcgtctcgcccggcgcgccccagatcagctcggcatagacgtcgagcccttcggccgacagccaggcggccagctccttccagtcgttgatccgcatgttgcgacggttcatcgtccccagcgtctcgtcgtcgagggtctggagcgccagggtgaaagaagattgcagcccctcgcgcttcatcagccggacgatgtcgcggaaggtcgcgttcttgttcttagcccacgaggtttccagtgccgtcgggaagccatagcggtcgcggatctcgatcagatcgcgcacgaaatccatgtcctggtggagcatgccgaaattggcatcgcacaggaccaccgtccgggcccccgcccgggccaccgcctccagctcggccctgaggcgcgcccgcgaaaagctgcggaccttctggccgacggccccaccccaatagcagaaggcacagtgataggggcagccgcgattggtctccatcagtgcgacgtcatagcggaacgcgccgtcgtcatcggtcagcgggatgacgccctccagaatcggcgaggggatggcatcgagattcaggatccgcggccgctcgggcgtggtgaccacgtcccccgcaccgtcacgaaacgagatgccggcgacatcgccgaggggcatcatgcccaaccgggcgcggacgatctcggtgaaggcgaactcgccctcgccgttcacgacgatgtcgacctcgggacagagccggaagatacgcgccgcctgattggcgacatgggttccgccgaagacgatcgtcaccccggggtcgacctgtctcagggtttcggccacggccgagaactggcgcaggttccagcccagcaccgagaagccgaccaggtcgggaaccccgtcctcaagcaggcgcaccgccatctccagcggcgtgaccgtgcccgagaaattggcgatcgacacctcgcaacctgttgcgagcaccgggtccgcacggatgcagccggcgagataaccggcggcaagcggcatggattccctggccatatgccagacgccctgctgaacgatcgtgatccgcatcttgcacgacctcgcgatcggcggcggccagtctgacgccggcgccgggttggtgactgggattgcggaggtgcgggaatgtcgatatcgagcctaggggagagccggatgcacagccaccccccaaagtttgccactacacatctaatagttgcagcaacatcgggcgccggtcagagactcattttctcctgtagtgctgcaaattagatttcatattatgaaactattcaattttacttagagaatgaggtttattcaccttcacataagatgtcgtctgctcagctaatcaaccttcttgaccagtcctgaactatgagccacgcttcacccattgatgtgacgatgtcagagaggcagcgcccgatgggtgggccgaccggtcgtccggagggcagcgagatgacccaggaccggatcattcatgatcagggacgggacgccttcgacttcatcgacgccgtctcggacctgcatgacccggacgagatcatcgcccggttccatcgggcggtggcccggtacggctatgccaccttcatcatcacgggcctgccgggcctgacggagccgttcgaaaccagggtgctgacacggcactggccggatgcctggttccggatctacacagccgagacctacattctggacgacccggtcggctggcactgccgggtggcccctgcccccttcgcctggtcggaggcccctttcgaccccggccgacagccgcgatcccggcggatcatggaagaggccgcaagcttcggaatgaaggacgggctgtgcgtgccggttcacggcctgcaggggctggactggtgcgtatcgctgggcgggcccgatcccgatctgtcaccacgcgcccgagccgccgtgcatctgatggcgctttatgccttcgacggcctgcgccgacggctgctcagccccgacaccccgccaccgcgccgcctgaccgcgcgcgagcgcgaggtgatcgcctggaccgccgccggcaaatcggcctgggaagcgagctgcatcctggggatcgccgaggataccgtgaacaagcacgccgcttctgccgcccgcaagctcaatgccgccaacaagacccaggccgtcgccgaggcgatccgtcggcacgagatcccctggtgagacgtatttccgatgaacctggaggacctgcgatgatccgtgtggtgggggccgcaaaccgatggcgtcaccgggcggcgatcgaggcacatcatcgcatccgccacgagatcttcgtcggcgagcgcggctggcacgaactggcccggcccgatggccgcgagatcgacgccttcgacgggcccgacgcgatctatgtgctcgccatggccggcgctgaggtgaccggcggcttccgactgtgcccgaccacagcgccgcatatgctgagcgaggtcttcccgcatctggtgaccaacggcccgctaccgcgcggcgaccatgttctggaatggacgcggctgttcgtcgcgcgcgatcaccgctcgggccggacctatttcgaactgctcgccgccctgcagagcctgtgcctccatgccggcatccgcgaggtgaccggggtgatcgaaagctggtggctgcccagatttcacgaagcgggcttcgcggtgcggccgctgggtctgccccagatggtggcaggccagccgacgcttgccatcgccatcgccatcgaccgcgccgcactcgcccgggtccgcgaactgggccatctgcggccacccccgccgctcgcttccccacccctcgccgcttcagggggcgagggtgccagccgtttcatgaccgatacccaacccgccccgcaaccagggagacccggatcgtgaccaccaccagcttctccgccccgatcgacgaccgctatttcgaggattatgtcccgggctcggtgttcgaattcggcagcctggaggtcgatgccgcggagatcgtggagttcgcccgcaaattcgacccgcagaccatgcacaccgatccggaagccgccgcaaagggcccgttcaaagggctgatcgccagcggctggcacagcgccgggttgatgatgcgcctgttcatcgacaactatctgtcgcatgtggcgagcctggcctcgcccggtgtcgacgaggtgcgctggtaccggccggtccggcccggcgatcggctgaagatccgcgtgacggtgatggaggcccggccctcggcgtcgaagcccgaccggggcatggtccgctcactggtcgaggtgatcaatcaggaagacgaggtggcgatgagcatgaaggcgatgaacctgctcgcccggcgccatccggccggcgccggctgaggcccggacggccccgtgcccgaagggctcaacgttctgcgccggtacccgcaaaggccgagatcagcatggccacccgcggatccggcctgagccccggagcggtataggcggcgatattgcccgcccggtcggccggggccggtttcagcacatggttgagcccggccaggatttcgatccgggtatctttcgggcggcccgcggccaggcggcgggcatcggcggtggtgacctgaaggtcgcgatcaccctgcaggatcaacaccggcccgccgaaacgctccatcacggtcgcggggtcgatgcccaaccacgagatcagatagggctgaacggaaggccggaacagcggcgccagttccagcggcacatcggcgaccttccggccggcaccgagatcggccaggatccggtcggcggtacggcgcagatcatccggcatcggggcctgggccagctggcgttccagcgtgcggatggcgggctcccccggggtcgcggccagcacgatggcatcgggtgcctcgcgccgtgccgccagcagggcgatcagcccgccttcgctgtggccgagcacgatcaccggcgccccgtcggccagtttgcgcgcggcacgggtccattgggcggcatccgaggccagcaggtcgatggtcatcagcgcctcgtcggcaatcgccgcccggctggcgccgatgccgcgcttgtcgacccgcaggctggcgatgccgcgcgccgccagatcttccgccagcatgcgcaacagatccgtgcgcagccccggctggttgccgtcgcgatcggtggggcccgaccccgccagcatcagcaccaccggcagcaccgcatcggcaccggcggcacagggaaagccgaaactgccgaccagatcgccggaagcgtcgaccggtgccggcattggcgccttgatcgcgatctgacgctcacacagggccgcagccggcgtcgccagctgcgcccgggccggggacggcgccagcaggccggcctgaaacgacacgaccgcggcgagcagagccgccgcggtcgcaaggcgtccggttgtccggaagcgcgccgtcatcagtcgagatcgccgacatcgccggaggtgccctcgaccctggccgacagcgccgcctgcatgaaggcatccagatcgccgttcagcaccgcctgggtgttgccggtctccacccccgtgcgcagatccttgaccatctggtaggggtgcagcacgtaggagcggatctggtggccccagccgatatcggtcttggcatccgcctcggcctgggccttttcttcccgcatcctgagttcgcgttcgtacagacgtgccttcagcatgcccatggcggtggcgcggttcttgtgctgcgaccggtcctgctggcactgcaccacgatgccggtgggcacatgggtgatgcggatggcgctgtccgtccggttgacgtgctggccaccggcacccgaggcccggtaggtatcgatgcgcagatccttgtccaggatctcgatgtcgatcgagtcgtcgatcaccggatagacatggacggcggcgaagctggtctggcgccgggcctggctgtcgaagggcgagatgcgcaccaaccggtgaacgccggtctcggtcttggcccagccgaaggcattctggcccttgatcagcagggtggccgacttgatgcccgcctcttcaccgtcggtctcttcgaccagctcggtcttatagccgtgcgattccgcccagcgcgtatacatgcgcagcagcatcagcgcccagtcctggctttcggtgccgccggcgccggcatggacttcaagatagctgtcgttgccgtcgacctcgcccgagagcaggctttcgaccttgagtttctgaagctcgtcgagcagccggccgagcgaagcctgggcctcgtcgacgacgctttcatcgtcttccatctcgcccagttcggcgagttccagatcgtcgcggaacgcctgttccagcttgcgatagcgctcgatggcgccttcgagctgggtgcgttcgcgcatcaccttctgcgcgcgcgccggatcatcccagagcttcggatcttcggagagggcgttcagctcttcgagccggatgagcgcgttctcccagtcaaagatacctcctcagcagaccgaaggtctgctcgatctcgtcggcgagcgacttgatctcggcgcgcatacgcacgtcctcccgttgatgatgatgccggcgcggatggcgccggcatggatatcgcggtgaccccgatcagtagaggccgcccggtgccggcgccgcggcgccgccataggggttcgaaggccgggccggcagggtgccgccggtacccgcaccggcgcccggatcgccataggtgccgtaatcgtcctgcatgcccgagaccatcgtcggctcggtgccgggcttgaacgcctcggtgatcaccgttgccgtatcggggccgggcagcaggccggtcttcgcgtcgacgcgcaccaggcggataccgctgggggtgcggaacggcgtcgccggtgcatcggccagcgcgcccttcatgaactcgatccagatcggcagcgcggccgaggcgccctgctcgttatcgccgagcgaacgcggcgtgtcaaagccgacatagacgcccaccaccaggtcggggctgaagcccatgaaccaggcgtcgaagctgtcattggtggtgccggtcttgccggccagcggcttgccgatcgacagcgcccggcggccggtgccgcgctggattacgccttccatgacatgcaccagctgataggcgtcgagcgggttcaacacctggtcgcgggtatcgggcagcaccggcggctgcaggcccggatgccattccggcaccgaacaggcctcgcacgggcgctcgtcgcggcggaagatggtcttgccgtcgcggtcctggatgcgctcgaccagcgccggatggatctgcctgccaccgttgacgaccatggcataggcggtggcgaggcgcatgagcgtggtttcgccggcgcccagcgccgtggagagatagggcggccagtcaccgatgccgagccggcgggcgatttccgaaatcgattcggcccccaggtcgcgggcaaggcgcacggtcatcagattgcgcgactgttccacgccgacgcgcagcgtggagggaccatagaaccggccgctgtaattcttcggccgccaggtgccgagaccggcgccctgatccagggcgagcggggcatcctggacgatcgaggccggcgtccagccgtgttcgaaggccgagagatagacgaaaggcttgaaggccgagcccggctggcgctgggcctgggtgacgcggttgaactcgctggcggcgaagttgaagccgccggtcatcgccagcacccggccgttatgcgggttcatcgccaccagaccgcccgagacgtcgggcacctggaccagtttcagcgcgccggcggcggccttgggcgccgggccctcgccgtcttcggcccggcggtcggcctccgccgccacctcggtcgggtcgtcggccggcgccacgaccacgatgtcgccggcgctgaccacatcgtccaccgcccggatcgccggcccgcgccggtcgaccgagacgtatttccgcgcccatttcaccgcctcgagatcgagcgtgccggcggcaccgtcggcgaagatcagcttcgcggccttgccgcccgcctcggtgaccagcgcatagcgccagcccggcaccagcggcttgtcgcggcccagatcctccagccgcttgcgggcggcctcgatgtcgtcggtggcaacgccgctctgcacagggccgcgatagccgtggcggcggtcgtaagaaaccagcccgtcgcgaagcgcggtgtcggccagggcctgaagcttgggatcgacggtggtcatcaccgtcagcccgccttcatagagttcgtcggacccgaagcgctgggcgatgtcgcggcggacctcttcgacgaaataatcggcgcgggcctggtcctcgccaccgcgcgggcgggtgaccagcggccgggcttcggcggcccgagcctcgtcggccgagatgtagccgtcctcggccatgcggctcagcacccagtcgcgacgggccttggcggcatcggcgcggcggatcgggttgtagttgttcggggccttgggcagagccgccagataggccgcctcttccgcggtcagctcgtcgagcgacttgtcgaaataggcgagcgccgccgccgcgacgccataggcgccatagcccagatagatctcgttcagatagagttcgagaatgtggtccttggtgaaggcgcgctcgatcctgagcgagagcagcgcctccttgaccttgcgctcgatcgacacctcgttggtcagcaggaagttcttggccacctgctgggtgatggtcgaggcgccgatgggccggcggtcgctggccagattgtcgatattggtcaccgcggcgcgcaggatcgcgaccacgtcgatgccgggatgggtgtagaagttctgatcctcggcggcgatgaaggcgtgtttcaccacatccgggatcgcatcgatcggcacgaagacgcgcttctcgcgggcatattcatccagcagccggccgtcaccggcatagatccgggtgacggtcggcggcttgtaatcggccagctgctcgaaatccggcagatcgccgtcatacatggtgacgccgtaatacagcgccgcgccgccagcgatggcgagcaggacgatgccggtcaggagaaaaccgagcaggcggatcaggctcatcggctgtgcaacgccgcgggccagggccggcggctcccatgtggttgacgggcggcgccagcggacggatccgtccctggtcgcggagccggagtgtggccgcgcgcggccctggcgtcaatcgcaggggtaccatccccgccctgcaagccacgcaaatgacacggcatcggaagggtttggcaggcccggcgaccgcctgggattcagagagggggtgggatcagagaagggccgggggtcagagacggctccaggtctgttcggcggcgaagaactgatcgacggcaccgacgatgctgcgggccagcttcgcccgatgagcggaatcctgcagcactttttcatcctgtcggttggacaggaagccggtctcgatcagcaccgagggcatgtcgggcgccttgagcaccgcaaagccggccgaacgcacgggcttggtcagcaattcggtatgcggctggacctggccgatgacatggccggcaaagcgcgccgacaggttcatggtctcgcgccgggccagatcgatcaggatcgaggtgacctcggcgctttcggtcgaaagatcgacgccggcgatcaggtcggacttgttttcgctgtcggccagctgggcggcgacaccgtccgaggcgcgttccgacagcgtgtaaatcgacaggccccgggtgcgcgggttctgcaccgaatcggcatggatcgagatgaacagctccgcctgggcggcacgggcgatggcgacccggtcgcgcagccggatgaagatgtcgcgatcgcgggtcagcaccgccttgtagcggccggtcttttcaagctcctgcgccagcgccttggccatggccagcgtgatcgacttttcctgcacgccggtgatgccgatggcgccgggatcgatgccgccatggccggcatcgatggcgacgatccgccggccgtcggtccgggcccgcggcctggccgcgtcgggcaggatcggcgcggcggcgaccgccgcctgccccgcaggcggctgcggggcagccgcgaccttggtgccgtcgaaccggtcttccggctcccccttcagggtggtgcgggcgaaggattgcgccgaggtgcgcgacagatcgaccacgaaacgcggcggcagaccgtcctgcgccggcagcacgaacatcgaatcgatctgcgacggctgggacaggtcgagcaccatgcgatagacgccgggttcgaacaggccgacgcgatagcgcgcgatcagcccggcgcccgaattctcgcccttgtcgaggatctgccagtccagattgcggaagtcgatcaccacccggtcggggcccgacagggtgaaggcccggaaatccacccgacggtccagatcgatcaccagccgggtcttgtcgggatgcatgccgaaccggaggccgaccgcacgggcggtttcgccggccaccgcctcttccggaccgacgcccggcagcggccctgcaatcaccgcgaccagcgccagcaggcagatcaccgccctgcccatggtgcgtttcgccatccggcccagccatgcggcagcccgccccggccgggacggcggagcggcggagatgcggcaaagatggtcggcggtctggcgaatggcaggcgcggacatgtgacggctccaggaggcgtcggcggctgatcctctgaccggccgcgccgcccgaaaaccgcccgcgaacgggtagctccgatgacaccgcaaccagcgactccttcgttttataggcggaagtcgcccaatctttcaatgcgtttatccatgttgttggcaccgggggtgaacttgcacgacgggttgtggccacggtgtgacatgccggtccgccacggtcgacccgaaacggctctcgcaggacgcggccgatgtggccgcatgcctgcgcaacacgcgcttgccctgtcgccggattgcaacagcgcgattgtggaagggccgcgacctgttctatagtgcggccgcgcgttccgcttcggtcaccggccctgccccgcctgggacaggatcgaccaccggatgggaggcgccggaattccgtatggccggaggcatcggaccgagttgatcggaccgcgccgctccgggagggagcatcccccggccgacggttgaacccgccgcgaggcaggacgacgacgacccagggcatgccggccacgcgacaagcgggccgggccggccggcggagagcgaaatccttgtgacgcggcggcggagcggggtgtgcggcaattacgcggcgcgcccctccgaccaacaaggaacggtcatgaacgacgcgcgcgatttcgcgcagagcgtcggtcgcacgggccctgaggcgtcttccgatgccacatccgtctgagcgtccggtgcatagcctgagaggcttcgactgccgccgatcgctcggcggtatgcgttccgtcgtcttcgtatcgttcccctgccatccgacaccgggcctgaccgtgccgcctgccgccgccgccctgaccggcgcccgcgcagccgacggccgcaaccccgcgcgtcgttcctccacatcctgcccgacggatctgcgccgcctgacgaaggccggcgcccgttgcggtcatatccggagttccacgctcgatgacgaagcgtatgctgatcgacgcgaaccaccccgaagaaatgcgggtggtcgtcaccaacggcaaccggcttgaagaattcgatttcgaaacctcgaccaagaagcagctgaaggggaatatctatctcgccaaggtgacccgggtggagccctcgctccaggccgcgttcgtcgattacggcggaaaccggaacggtttcctggccttcagcgagatccatcccgactacttccagatccccgtggccgaccgtgaagccctggtccgcgaggtcgagaaagcagcgcgcgaggatgccgagcgcgaagcccgcgccgatgccggcgaaggccccgagatcgaggaggtcggcggttccgacgtcgacgacatcgcggccggcggcgccagccggcggcggctgcagccgcaccgccagtacaagatccaggaagtcatcaagaagcggcagctgatcctggtccaggtggccaaggaagagcgcggcaccaagggtgcggccctgaccagctatatttcgctggccggccgctattgcgtgctgatgcccaacacgcccaatggcggcggcatctcgcgcaagatttcggacgcccgcacccgcaagaagctgcgcgagaccctgaccgagctgggcacccccgccggcatgagcgtggtgctgcgcaccgccggcgccgagcgcaccaagaccgagatcaagcgcgactacgaatatctctcgcggctgtgggacgacatccgcgagcggaccctgtcgtcgcgcgccccggccctgatctatgaagaggccgacatcatcaagcggtcgatccgcgacatctattccaacgacatcgacgaactgctggtcgagggcagcgacggctatcgcgccgcgaaggagttcatgcggatgctgatgcccagccgcgcgcggctggtgaagcagtatggcgaccgcatccccctcttccaccgctatcaggtcgaaacccagctcgcctcgatgcactcccccaccgtgcgcctgccctcgggcggctatgtggtgatcaaccagaccgaggcgctggtcgcgatcgacgtcaattcgggccgctccacccgcgagcggaacatcgaagagaccgcgctcaagaccaatctggaagccgccgacgaggtcgcccgccagctgcgcctgcgcgacctggccgggctgatcgtcatcgacttcatcgacatggacgaccgcaagaacaaccgtgcggtcgaacggcgcctgaaagaggcgatgaaagccgatcgcgcccgcatccagctgggccggatcagcggtttcggcctgctggaactgtcgcgccagcggctgcgcccgtcgctgatcgaggccagcaccatgcagtgcccgcattgcggcggcaccggtctggtccggtcggtggaaagcaccgcccttgccgctctgcgcgcggtggaagaggaaggcatccgcgagcgcaccgaggagctggtgctgcgcgtgccgaccgaggttgcgctctatatcttcaaccacaagcgcgacatgctggcggatatcgaggcccgctatgtcttccgcgtgctggtggaagccgccgacaacctgacgccgcccacgccttacgagctggagcgcacccgccagcgcaaggaaggcgagatccccgagcgcccggccggcagcgagcgcccggtgaccgccgaatcctcggcagccgccgccgatgccgatgccgcgcgcatcgcggctgaggttgccgaagccgaggccgaggaagaggcgatggcggaggcagaggccgccgccgaggcccggagcgaggccgaagccgagacccggcccgaggccgacagccagagcgaggaagagcggaaccgccgcaagcggcgccgccggtcgcgccggcggaagcgtcgcgacgacgagacccagtcgaccgccgagggcgaggatcaggccgaggaccaggacgaagacggcgaggccgagggtgacaccgaggccgacaccgccacgaccgaggccgaaggcgagagcaccgaagacgcccggaatgccgacgaccggaatgccgaggagcggaatgccgaggagaacggccgccgtcgccgtcggcgtcgccggcgtcgcccgggcaatggcgaggtccgcatcgaggcccagaccacagacggggagcaggccaccgacgaagagcaggccggcgacgaggcagagaacgccgaggccgagaccgccgaggcggtgagcgaaacggaaaccccggcagtcgaagcgcccggcgcggagagcgaggtcgtcgagcccgtggccgaggtggtcgaagccgaagagggtcgcggccgtcgccgccgccgtcgtcgtcggccgggtgaggtcgaggcggtcgcggccgtcgaagccgatgccgcccccgctccggtgagcgacgaggcgcccgtgagcgagccggagcccgtgagcgagccagcttccgtgagcgaaacggggccggcgagcgacgagacgcccgccgaagcggcacctgtcgacaccgcagcggtcgacctggcaccggctgaagagaccgtggccaccgacgcccccgccgcggagtccgaggcgccggtcagcgaacccgagcccgtccccgaacccgcccccgaacccgagatggtcggtgcggatctggtgcccgaagccgatgccgtggtcgaggccgatgcggtggttgccgccgaagagccggtggccgcaccggagaagccgaagcgccgccgcaaggtgaaggcagagaccgaagccgaggcgcccgccgaggccgcgccgaagccgcgccgccgccgcaaggtggccgagactgccgcggacgccccggccgaagccgaggcggtggcagaggcggcccccacccgcaagcgggcgacgcgcgccaaggcgacgacggccaaggcgacggcggccaaggctgcgaccaccaaggccgccgcggccaagaccacccgcgcccgcaaggcgaaggcggtcgagggggctgagcccgtcgaggctgccgccgaggcaccgaagccgcgccgccgccgcaaggcggagcctgcggtggaggcggccgagccggccctggtcgtgaccgccgtggaaaccggtgccgagccgccggtgatcgacggcccggccgccgccgcggtggccgaagccgccgaagccccggccgccccgctggagccgcccttccgcgaggaagcgaccgccgagacggcaccggaggccaccgaagcggagaccggcacgaaggccgagccgcagccggccggcgatgacgagccggccgtgacggtgatcgaggccgaaggcgcgccagagcgcccgcgccgcggctggtgggcctctcgcggccgcagctgacggtcgcccccggagccggctcatgccggctccggccagcgatccaaacaagcccacgatcaaaataatggggccgccggttcgaccggcggcccctttatcgtctccgaacggctggcgtcgggtcaggcgaccttgccgacgccgaagctgcggcgcatccagccgtccagccggtcgaccacctgcaccatatcttcggtagacccggcaaaggccatgcgcagatagtgatggcccttgaacgggtcgaaatcgacaccgggcgtggcggcgatgccggcctcgtgcagcatgcggcggcagaaatcgatgctgtcggtgctgtagtcggaaatgtcggcccagacatagaaggcaccgtcgatcggcgcgatccggcccagcccgaccttgggcagaccctccagcagcacccggcggttctcggcataacgcttcaccgcaatctctgcctcgtcatagccgtcgaaggccgccgtggcagcgatctgggccaccgccgagggcgagaggaagaagttctgcgccagcttttcacccgtgcgggccatgtcttccggcaggatcatccagcccatgcgccagccggtcatggcgaaatacttggagaagctgttcaccacgatcggcgcctgcgagaagttcagcgcgctgcgggtgggccggccataagtcagcccgtgatagatctcgtccgagatcagcgtgatgcccttcgcctcgcaatagcgcaccagggcctccagctcttcgggcttcagcgtggtgctggtggggttggagggactggcgacgatcagcccgtcgatcggcttgtccagtgcctccagatgggcaatggtcggctggaagcggctttcggggccggtctcgatcgacacgacctcgatgtcgagcgccttcagcacattgcgatacgaggtatagcccggctccgccatcgcgacccgcgcacccgcatcgaaggccgccaggaaggcgatggtaaagcagcccgacgccccatgggtgatcaggatgcgctcgatcgggatctcgagcccgtaccacgaccggtaatgcgcggcgatccgccggcgcagcgccggctgcccggccccttcggtatagccgaaagccggcccgtcgagcgcggcgcgggccgcacggatcgccggcgccggcgcaccggtcgacggctggccgacttccatatggataatgtgacggccggcagcctcgagcgcattcgcctcggccagcacctccagcgcgtggaacggggggatctgcgagcgacgggaaacgggcatggaatggggtatccttctgcaggggccgcgccccagggggaggacggcctgcacggaatgcgacagatccgaccgggattatgaaaccataagttcataatcccggtcatgccaatcgcgaagtgctgaggatcagcggatggccagccccggcgacgagggcgagacgatggcgttgcagcgctgatcgtcggacggaatgccgttggcacaggcggcggcaccgatatcggcgccggccgtggcggcggcggcgagcgagtcgtccagcggttcgccgccgtagaagctgccgatcagccggctcatcgccggcacggcgccctcgccggtcgccgttgcggccatatagggcttgtagatgttggtgttgaccgccagcaccgcggcgcccgaggcggttgctgccggatcgagcggccgcgcggcgatgatgccggtatcgtcgcccatccggccggtgccgaagggggcaccctgggtgaaggtgcaggccactgcctggccgtactggtcgatggccagaatgccggactgcacggcatcatggccggccaccggcagcgccgtgccggtgcgcacggtcgaaagcgcatccagcgccgccgccccgccggtgccggggatggtgaccatgtcgaaattgccgagcgagcgggtcagcgcatcgcccttggcgggctgataggcgcgcagttcctcggccctgagcgtgacgcccgcctgggcgaaatcctcgatcatccgtcggcccagcggccccgcatagagcgtgcccgggccttcggtgcgcagcgagcccagcgaggaggcgagatccggccgggtcatctgattgccctgggccagattgccgaagctgcgcgccagcgtgggcgaggccgagatcacctcgcgataggcggcgagatcggccgcgaaggccggcgagacctgcgcgccgaaccgggccagctgctcggccggagagaccagctgcggcaggcgcagcacgccgtaatcggcatgcatggtgaacagcccgcgcgcgaagcccggcaccgccaccgtctcgccgggcacggcggcctggggcatgaaggcataggcgcgcggcggctccgcctccttgggcttggtgcggcgcgactgggccttgtagaccacgcaggctccgccaccgcccagccccacgcggctcggcaacgtgacggtctgggtgaaggccatggccaccgccgcatcgaccgcgctgccaccggccgacaggatgtcgcggccgaccagcgccgagcgtggctcgtcggcagcgatcaggccgatgaagccggtcacggcatccacctggcccacttccacgcgcggcccgcagcccgccagcacggcaaggctcacgatcgcgagagctgccggtgcttcacggagatgccacggttgccgagattgacgggcgtgtcgtgcgaccctacgttcggtgaagacatccggggtctgcaccgtgcgctcaagcttcctccgcatcgccgtccttatctgcttcctgatcgtgtcggggatcggtgccgtgggccccgcttcggcgcagcagcgaagcctgtccttcatccgcgacgccgaggtggaacataccatccggcagatagcgactccactgttcaaggcggccgatctcgacccgaacgcgatcgacatccacctgatccgcgacaacgccatcaacgccttcgtcggcggcggcatgcacctgttcatcttcacggggctgctgatggccagcgacaaccccaaccagatcgcgggcgtgatcgcacatgaaaccggccatatcgccggcggccatctgtcgcgcatcggcggtgcggtcgagatggcgaccgcccaggccatcgcctcggccctgctggggcttgcgatcggtgtcgccggcggcagcgccgatgccggcatggcgatcgcgatgggcggccagcagatggcccagcgcggcatgctgagcttcagccgcgcccaggagaattcggccgaccaggcgggcatccgcttcctgcaccgggcgggcgaatccgcactgggcatgctccagttcttcgagaagctcgacacccagaacgcgctgatcggcagccgccagagcccgtacctctccacccaccccatggccgccgaccgggtgcgggtggtcgagaacgtggtggcccaggaaaagggtgtcagcgccgaagcgacgcccgagcagcagatggcctatgaccggatgatcgccaagctgcgcggcttcctggacccgcccggccgcacctttgccgcctataaggccgatgacacctcggtgcccgcgcgctatgcccgcgccatcgcctattaccgccaggccgatctggaccacgccctgccgctgatccgcgggctgatcgccgaacagcccgacgatccctatttccacgagctggaaggccagatgctgttcgagaacggccgggtggccgaggcgatcaagccctatcggctggcggtggaaaaatccgaccgtgcgccgctgatcgcggtcggcctggcccaggcgctgatcgagaccggcaccgatgccgcctataccgaggcccaggcgctgcttgaaaacgcgaccgcgaaagaccgcgacaacgccaccgcctggcggctgctgggcatcgcctatggccgcgccgaccgcatgccgcaggcctcgctggccttggccgaatacaacgcccagatcggccgctgggacgaggccgaggtccaggcaacccgcgcccgcgacaacctgccggtcggttctcccggccagctgcgcgccgatgatctggcagaatacgtcaagcgccagcgcgaggaagcccgcgccaatcgttgagaccacggggcgcctgccctgtcgtcctgaaccaccccactccgctccgaaagacaccagaccccatgtcgaaactcctcgtcccggccctggccctgatcctgggtgctgccggcggtgccgccgcgaccctggtcatcgaccgtatccacgccgtggacccggcatcggaagcccgggccggcgaggacatggtccgggccctgctggcgcgcgaacccgaactggtggtggaaagcatccgggcctggcaggcgaagcagcagaccgcggaactggaagcccagggctcggcgatccgcgacagcgaggccgccctcgtcgccgatcagcgcgacccggtcgtcggcccggccgatgcggcagtgacggtggtccagttcttcgactatcgctgcccctattgccgccgcgccatgggcacggtcgaccagctgatcgaaaagcgcgacgacatccgcgtggtctacaaggaattcccgatcctgggcccggattcgctgatcgccgcccgcgcggccctggccgtgaaccaggtggcccccaaggcctatcctgaagttcacaccgcgctgatgacccagcagggcagcctgaccgaagaccgcgtgctcgccatcgtcgccgatcgcggcatcgacgccgaggcggtcaaggcacgcatgcacgcgcccgagaccgaggcccatatccgcgataccatggatctggcgcgcaagctcggcatcggcggcaccccggccttcgtgatcggcgacaccctgctgccgggcgcggtggaactcgacgccctggaccgtgcggtcgaggcggcgaagggctgagacctcacacccgtggcacggccacagcgatcccccgcgccgccagcaggcgcggggcgatggtagcgagatcggggaagcggtcggcgatggcatctgcaccctcggccatggcgagggggccgtggccccagccggcgaagatgaccggcatgccggcgccccgggccgagacgacgtcgttgcggtggtcgcccaccatcaccgccggggcgtggtcgaggccgaccgcctgcagcgtcagggtcaggtggcgcggatcgggtttggagaccgggaagctgtcgccggcgccgatgccgtcgaaacgcgacagcaagcccagcccatcgagcagggtgcgggtggcggtcgccggtttcttggtgcacagcagcaccgcccagccggcagcacggaaggcatccagggtttcgggcacacccggaaaggccgtggtcgccccggcggcatgggcggtgtaatcggcgaggaagcggtcatgcgccgcctcgtccatcggccggtcgcgggccgccagcacccgttccaccagcttgcgcggcccgtcgcccagatagccggcgatttcaggaccggatacctcgggcaatcccagcgccgtcatcagccggttcatcgccgccgcgaaatccggcacggcatcgaccacggtgccgtcgaggtcgaggagaagggcgggacgggtcatctgccgaggactccggcttggggggagaggcgctgcagaatagcagccgccgcccgatgccgcgacagccggttccccgcgcctgcggccggctgacgcaggcgatgacgccccctgtcccccgcccgccacagactgcatactcgccgccatggacctgtatcgcccgaccgcccatcccctgccccaggactcgcgtctccgcccgatgttcgtcggcgcggatctggccgactgctatgccatcggcctgccggccggcgtaggcggcgatccggaacatctggcgcgcgtcctgttcgcgggccaggccggctgggcccggcgcctgctgaagctgcgcgacctgctggtccgccccttcggcctcaagacctcggacagcatggcggctgccggagatgccggcgatcctggcaaccgtcggatcggcatcttccggatctacgaaacccggccggatgagatcatcctgggcgaggatgaccgccatctggatttccgtctgacggtgcgcgtggcccccgatcccgaccgcctgggagagcggctggtgatgaccgcaaccgcggttcgctgccacaacggtctgggccggctgtacatcgccctgatccgccccttccatgtggcggtggtgcgctcaggcctggcacgggcagcgcgggcgggatggcagggataggcgccgcgtccacccggcaccatgatccgggcggaagtttgcctcagctccgtgaaaggcatatgttatggacatatgcctgaggtgctgccccatgaacgacacgcgcatccgccatgttcgcctgttccgcaacggccgcaatcaggcggtgcgcattcccgtggatttcgagctgccgggagacgaggccattctgcggcgcgagggagatctgctgatcctggaacccgtgcgcaaacgcggcctggtcgcattgctcgacagttgggagccgatcgacgcagcactgcctgagatcgaggaccagccgaccgtgccggaggatatattttgagccggctttacatgctcgacaccaacatcatttccgatgtcgtccgcaatccgcgtggtgggcctgcattaaggctgtgaagcatcccccagcaagacttgtgcaccagcatcatcgtggctgctgaactgcgctatggctgtgcgaagaagggttccgaccggttgtcggagcgtgtcgaaggcattctggccgaaataccggttcttggctttgatgttcccggagatgttgcctacggcatgattcgcgcggagttggaaagcaaaggcctccccatcggctacaacgatgcgctgatcgctgcgcatgcccgttccctgaatgcgatcatcgtgacggccaacatccgcgagttttcgagagtctccgatctcgatgtcgagaactggctggcgtaagaggtgacctggttcacccctcatccccattcaggcaccggctacccgccacttacacctggaagatcgatgcccgccggctcatgatccggcggccggcttcacgcccgatgcctgcagctgcatcacgatcagccccagaatgatcaggcccagcccggcgaggcggggcagcgagaccggcttctgcgggaggccgaccaggccccaatggtcgatgatgaccgaggccagcatctggccggcgatggccgcggtgatgaagccggcggcccccagtttcggcgccagcacaagcgcaccggtaatatagaccacgccgacgatcccgccgatccatatccagcgcggcgcctgggcgagattggacagggccggcatctcgacgcgcgccagcagcatgaccggcaggatgcaggcgaagctgacgcacagcgatatggcggtaccccagagagggtgtccgagcgtccgcccgagaaccgcattggcgcccgcctgaaacgggacgacggcacccgagacgatcgcggcgaggatgagaagcagtgagctggtgtgcatgatgaacctccatgttcatcagatgcaatatctgcttcgcgaatggaaattcggatataatatcccctatatgcaacagatgaataatcttcgcggtatcgacctcaacctgctggtggtgctcgatgcgcttctggccgagcggcatgtgtcgcgcgcggccgcccggctgaatatgagccagccggccgtcagccacgcgctcgggcgtctgcggcatctgttcgacgacccgctgttgatccgccgcaacgggcagttgacgccgagcgcccgggcgctggacatcgcccccgcactgaccgaggccttgcgacagctgcaggaggttctgggaccgggaggcttcgacccggcgcaggaaatgcggcgtttccgcctggcgatgtcggactacggctctgccgtcatccttcccgacctgctgaacatgctgcgccgggaagcaccgggggtcgagctggtgatcacccaggcgagccgggaggcgatgcttcggcaggtgctggacggggaatgcgatctggcactgggcgtgtttcccgatcttcccccgcggatcgaggccgaacgacttttcgacgagcatttcgcctgccttgcggatcgccaggggctggacggccgtgatcgtctggatctggccgcctatctcgcccggccccatgtgctggttgcgatgcagaacgacgccgataccgggatcgatacggccctgcacgccatcggccacacgcgccgtatcgtcgtcacactgccgcattggggcactgcgccacggctgatccgggggacggacctggttctgaccgtcgctcgcaaaaccctggccctctgcgaagatgatccggtcctcgccgtcttcgccccgccctttgcgatcccgccctttcccttcgttcaggtctggcatgaacggcgcagcagcgatcccgcgcatctgtggttgcgtcgcgccgtcgcaagtacctctacgtctgactaggtgtcagccagccggcgccggtgccgatgatccggttccggatgatcaggacccgaaaaatcatgacgcgagatgcatgaagcgtcctgggaattccccctgatccttcaccacttctcaactcttttcagaataatcttccgccgacggcgatatgatcatgaaaaccatcatcacctccgattgacaagactggtggggctcgccatcggaattgcgcggtctgcttgtccgctgctccgcaccccacctccgaggcgtggaaggtgagttgtcatgtccttcatcaagctgccgtccttaaccgatcacgacatcctgaaggcgctcgacctgtcgcaggcgaccgtccatttctcctccgagggcacggtcctggcggccaacgacaatttcctgaagctgatgggctatcggctggaggaggtcgccggcaagcaccacggcatgttcgtgacccaggccgagcggaacgccccggactaccgggccttctggcaagacctggccgcgggcaacttccgcaaggcggtgttcagacgggtgacccgcgagggtcgcgagatcttcatccaggcgacctacaccccgatccgggatcacaagggtcgggtgcggcgggtgatcaagttcgcgaccgacgtaacggccgacgttctgaagaccgcggaatatgaaggccagatcaccgcgatccagaagagccaggcggtgatccacttcacgcccgatggtacggtcctctgggccaacgacctgtttctgaacgtgatgggctatcgcctggacgagatccagggcaagccgcatgccctgttcgtcgacgacgcccatgcggccagccaggactatcgcgcgttctgggcagatctgaggctgggtcaggccaggacggcagaattccgccgcctcgccaagggcgggcgcgaggtctggattcaggcgacctacacgcccatcctggatcctgccggccagctggtgaaggtggtgaaatatgcaaccgacatcaccgcgcagaagctggtaacggccgactatcagggccagatggcggccatcggccggacccatgcggtgatcgagttcggtctggacggcagggtgctgcaggccaacgacaatttcctcgccgccaccggctatcggctggacgagatccagggcaagccccacggcatgttcatgcccgaggccgaggtgaagaccgacgcctatcaggccttctggcaaaagcttcgcgccggcgatttcgtcaccggcatccataagcggctcggcaagggcggccgggtggtctggctgcgcgccacctacaacccgattttcgatgcctcgggccgggtctgcaaggtggtcaaatacgcgaccgacatcacccggctgatgacctcgcatctggcggcggtgtcgtcggccgaagtgacgctcgccaatgtcgaggcggtggccgccgcctcggaagagctgacggcctcggtcgccgagatcacccgtgccgccgacagcggccaccgctccgccgaaaccatgcgagacaacgtctcccgcggcgaggaagccgtcgcgcggctgaaagagacgaccagcgcgatgaacggggtgatcaagctgatccaggacatcgccacgcagatcaacctgctgtcgctgaacgccaccatcgaggcgtcgcgcgcgggcgaagccggccgcggcttcaccgtcgtcgcctccgagatcaagaccctgtccggccagacggcaaccgccaccgagaacatcgcccgccagatcgccgaactgcaggaggtctcgcagaccgtcgacggcacgatgtccggcatcaccggcggcatcctgcaactgcacgaggccagcgccgtgctctcttcggcgatcgaggaacagctggccatgacccgcagcatcgcgagcaacatgcacaaggcggtcgacggcgtgaccggcaccaccgacaacctgacgaagatggtgcagtaggccacagcgaaacacggcccgccggattcccccggcgggccgtttcacgtcagacagaaccggatcggccgcccctcagccccacttcacgccctcaaccccacttcacaatcttctggtcgatcgcgccgaagatcgagacctcctcgcggtcggtcatctcgatgcgcacgcggtcaccgaaggacatgaacggggtagaaggcttgccggcatcgatcgtctccagcatgcgccgctcggcgatgcagcacgaaccgcggctgcggtcgagattggagacggtacccgagcccacgatggtgccggcgcccagatggcgggtgcgggcggcatgggcgaccaggcggcggaagtcgaaggtcatgtcctcgcccgcctctggcgcgccgaacagatcgtcgttcagccagaccttgagcggcaggttgaccttgccgccatcccaggcgtcgcccagctcgtccggggtgaccgcgacgggggagaagctggaggccggcttcgactggaagaagccgaaacccttggccagctcacccgggatcagattgcgcaggctgacatcgttgaccagcatgaccagacggatatagccgccggcctgctccggcgccgtgcccatcggcacgtcgtcggtgacgaccgcgacctcggcctcgaaatcgatgccgaaggcctcgtcggcgcattccaccggatccatcgggccgatgaagcggtcggagacgccctgatacatcagcgggtcatgccagaagttctggggcatctcggcgccgcgcgccttgcggaccagctcgacatggttcacataagccgagccgtcggcccattgataggcgcgcggcagcggcgccatcgtcgccacgggatcgaagccgatcacgccatcgacctcgcccgcattcagcgtctcggacagggcctgaagccggggagcggtttcggcccagcggtccagcgccgcctgcagggtgggggcgatgccctccgccggcacgcagtgcttcagatcccgcgagaccaccaccagccgcccgtcgcggctgccgtccttgagggtcgccagcttcatcgtcactccgccgcttcgttggtcgcagccggctgcgtgcgccagctgtcgacgtaaccggtccattccacactggccgcacccgcctgaacctccagcgggtcgcgggtgtcgatcatcaccgccacctcgtcggtctccttgcgtgcggccttctggccgatggcaaaagccttggggtggggcccgtgggcaaagcccgccgggtgcaggctgatcatgccgggatggatgttgtcccggctgaagaacgagccccggtgatagaagatgaactcgtcgtagtcgacgttcgaatggaagaacggcaccttgagcgcccccggatcgctttcgatcggccggggcacgaaggtgcagaccacgaagcgctcgcccacgaaagtggtgtgggccgagggcggcagatggtagcgatggctcatcagcggccggatgtcgcgccagttcaccttcaccggcgccaggtcgccatgccagcccaccgcatccagcgggttgtacgggaagaccatggtcgaaacctcgccgaagcgcttcaccgccacccgggtctcggtttcggagcgctggtcgtcgaaggcctcgtcgatcaccggcacggccaggatcgccggatcgaagatcgcatgcggccccacgatgcccttgtcgggcagcttgtaggcggaatccgtcgcctcgatcatcagcacccgggtcggcgcctcgggcaccagacgccacatcgtgccgcgaggcagcaggatgtagtcgccttcggcataggtcatatggccgaaatcgcagaacagatggccggcgccgtcatggatgaacagcagctcgtcgccatcggcattgcgcgccagatgatccatcggcgcatcgatccgccagaagcgcaccgcgcagcggcggttgccgaccagcgcctcggccgaccaggggccggcgggcaccgcatcgaatttcgtggtgtcgaaggcgcgcggccggatcgggccttcgaaccgcacccagccggtcggggcatgggcatggtggatatgggcggccgggccgaagaagccttcccgcccgatctcgtgctcgaaggtgccgtcgggcaggtccgcatgggcctgccgcgacgcccggccttcgacgcgcgggatgttgatccagttacgcatcggcgctcaacactccgcgcttgatctggtcgagttccatcgcctcgaacagcgccttgaaattgccttcgccgaagccctcattgcccttgcgctgaatgatctcgaagaagatcgggccgatgacgttttcggtgaagatctgcagcagcatgccgacatgattgtcgggcagaccgtcgatcaggatgtggtcgcggcgcatccgctccagatcctcgccatggtccggcacgcgggtgtcgaccatgtcgtaatagctggacggcgtttccaggaaggcgacgccgcgctcgcgcatgccctcgaccgagcggaagatcgcctcggtgccgagcgcgatatgctggatgccctcgccgttataggcctggagatattcctcgatctgcgacttgtcgtcggccgattcgttgatcgggatccggatcttgccgcaggggctggtcatcgcacgcgaatgcaggccggtcagcttgccttcaatgtcgaaatagcggatctcgcggaaattgaacagcttggtgtagaattccgcccagtgattcatccgcccgcgatgcacgttgtgggtcagatggtcgatataggtgaggccctgatcattggcggcggcctccgccccctcgatcggctcgaaatcgatgtcgtagatcgtgccccgggcgccgtagcggtcgaccagatagatcacgctgccgccgatgccctggatggccgggatgttcagctccatcgggcccacctggcccagatgcggcttggcgcccagctccagcgcgcgcttataggcgaagcgcgcatccttgacccggaaggccatggcgcaggcgccggggccgtgcacccgggcgaaggactgcgcgaagctctcgggctcggcattgacgatgaaattgatgtcgccctggcggtagagggtgacgtccttgctgcggtgacgcgcgacggcggtaaagcccatccgctcgaacagcgcccccatctccaccgggtcggggctggcaaactcgacgaactcgaagccgtcggtgcccatcgggttctcgaaaccgaacggcgtatcgccgccaatcctgctttccgcgctcatcgctttccccctcgacgtgccacggctaccatcctgcccccgggacggcacgcggacgacgccctgcaggactgcaaggatcgggagaccgggccttccggggctcgacgtcgccgtcggcacctgatagtttcatttgtaaccaagttgcccccggacccgggcaatgtcaagcggaggccatcatccggtgagcgaaagcgccagccctgcccccggttccaatcccgcccccggcaccagtgccgagccgggttccggttccggcagccggccgaatccggcacgcggcgaggacggcaagagcctgaggctggagcgtttcctgccctaccggctgtcgatcctggccaaccggatctcctccaccctggcccgcgcctatgccgagacgttcgacctcaccattcccgaatggcgggtgatggcggtgctgggccggtttgcccccctcaccgccaatgcaatctgcgaggcgacgcagatggacaaggtgacggtcagccgcgccgtgcagcggctggagcgcgcccggcggatcgagcgcaccaccgacgcggccgatcgccgccgggtgctgctgcggctgtcggccgacgggctggatgtctatggccggatcgcgccgctggcgctggattacgaagaacggctgatcgccgacctgacgcccgaagaacgcgacgccctggtcctgctgatcgatcgcctgaccgacatggccgcccgcaccgaggtctgaccgggttcatcaatcataagtagatgaaatggacaaggctgccaggcggcggcgccgtgcgccggcaaatgggcgcgacagaatgtgacgcggcgcagcacatctatcggctttgcgtcgtcttcgatcgatattttatgcagatgacatctgtaaaaactggcggaatacggccgaattcgatgccgtgacagccttcccgcccgcgggtccacgatgtgtgcaccgcacgatatatcctcttgttgcgccgccgcatcctgcactacagttaaagcagggtgacatacaggcgtgacacttcggcatcgcaggatcggtgcagcccccgggtggatcgccttcaacgcgtgacacatacaagcaatacgcggccaaccgcgaccggagacgccttctgcgaccggaaaagatagggggtttggtgatgaccagtcagatgccactcgcagtgcgtgccgcggccgatgccgtcgctgccgaaaccgtctcggcgcagaaggtccgcggcctgatgcaggggctgagcgacgatgtccggcgcttttccagcggcaaccaggaaatcgccgcacgcacccggctgctggccctgaacgcggcgatcgaggccgcccgcgccggcaatgccggtcgcggcttttcggtggtcgcgggcgaggtcaaaagcctcgccgaacaggcggacggtgccgcaaaacgcttccagcaggagatcatcggccggatcgccgattgcgaggcggtgacccagcgtctggtcggccagcgcggccaggaactggccaaggccctggtgcagctgatcgtccgcaatctgtacgaacgcacctgcgatgtgcggtggtgggcgaccgacaccgccttctgggaagcgctggaggagccgtcgcgtgaggcgttggaacatgccgccatgcggctctcggtcatccaccgctattacaccgtctatacaaatctggtgctgaccgatgcgtcgggccgggtggtcgccatggccgacgacagtttccagcgcatgcgcggcgccgatctgtcacgggaagcctgggtgcgtgatgccctcgccacccgcagcggcgatgaatacatcgtcgacgacgtgcgcaccgacgccatgcacgacaatcgctcggttctggtctatgcaaccgcagtgcgcgagggcgggcgcaccgacggccggatcatcggcacgctcggcatctatttcgactgggaacgccagggccgctcgatcgtggtcgatgaaccctcgctgtcggccgatgaatggacccgctcgcgggtactgctgctggatcgcgcccggcgcgtgatcgccgcttccgacggccaggggctttatcagaccttccacctgtcgaccgacggcgccaaacagggcacctatatgaccggcgacacggtgatcggcttctccgaaaccatcggctatcaggaatatgacggcctgggctggatgggtgtcgtcgtccagcgcatgaagtaagcctggggctgccctcggccgcccggtccgctaggatggggcggccggccgcagcacccgccttccgcgcggtccggccagcccggagcccgagccgcgagccatgaccagccccagtcttcctttgccccagggccgcccgcaaagccggcgcaaccgtctggtacgccggctgcgcgcgataaccggcgcgatcatgctggtcttcgtcaccggccatctgatcgcccatgccagcgggctgttcggcatcggcgttgcccagaaggtgctggacgtcaccatggcgccctggacggtgccgccgggcagcctgctgctgccggcggcctttctgctccatgccgccctgggtctgcgcgcgctttatctgcgccgcagcctgcgcatgccgcccaccgaggcgctgcagctgacgctcggcctggcgctgcccctgctgctggctgcccatatcaccggggtcgatgccgcactcagcgccgatgcgggggtcgacagctatacccggatcatggccctgctctggacacccaccggggcgctgcgccagttcgtgctgctgggggtggtctggctgcacggcatgatcggtctcggcttctggctgaaggggcgcggggccggcgcgggctggatcgccgcctggcggatcggcgcctgggcgctgccgctcgccgcactgctgggcttcctggatgccggccgcagcgtggccgggctgatgaagctggggctgctgtcgccgacgctgtctgccctgcccgccgacctccatgcccgggcccaggcgggcgagcatgcgatgatgtccgcctggatcctggcgatcgtcgccaccttcgccgcccgcggcctgcgccacctgatctcgctgcgccacggccggatcaccgtgacctatcccggcggtcgcacggtccgcatgattccgggcgcctcggtgctggaggcgagtcggctgggcaatgtgccccatgtggcggtctgcggcggccgcggccgctgttccacctgccgggtggaaatcgtgcgcgggctggaaaacctgccgccggccgatgccgaagaatcggccctgctgtcgcgcatccgcgcgcccgcgggcgtgcggttggcctgccggctgcatccgaccgggccggtgacggtgcacccgctgctcaaggcccagggccacggccggcggccgtcggaggatccgatggtgcatggcgggcgcgagaagcgggtcgccatcctgttcaccgacatccgcggctccaccgccatcgccgaacagcgcccgccctatgacatcatgttcctgctggaacgctatttcgagaccatcggcggcgctgtcgaagcggccggcggcacacccaacgccttcgtcggcgacgaggtgatggcgatcttcggtgcggatggcggcgatggccctgaagatttcgccgcggcggccacccaggccctgcacgcggcaggcgagatcgcccgccggctggaggtgctgaaccgcagcctggtgcgcgatctgggccagccgctcaggatcggcatcggcatccatggcgggccggcggtggtcggccggctgggctatggcgaaacccggatgctgaccgcggtgggcgataccgtccatgtcgcccggcggctggaagagctgaccaaggcccatgcctgcctgctggtggtatcggacgacatcctgcaggcggccggacgggccccggcgacgctggatgccagctgccacgaaatcaccgtccgcggccgggtggaaccgctggcggtgcatgcggtgccggccgaggcggtgcaccggctgggcggctgaccctcagccgcggccggagccgggcgccagatcgaagatcgacccctcgcgctcccaggcgcggatccgggcgtaatccgccgccagcaccgccgcatcctcgtggaccagatagaccacccccgggcttgagaaatagtcgatcgtgggcctgagccgcaccccaggccccgccacggcgatcgaggaggcataggaggcgaggccttcgatccgcgcgaagcccgaacggccggtgatgatgccctcatgctctgaaatcagcgccacgcaccagatctccgccgccatccggtagggctggtcgagccgggaaaggaagcccgccggatcggtcaccgcctgcaccgcaagatcagcctgggtgacccccaggctgcgccgcaccgcctgctgttccaccgtgcccatcagccgggcggcggtttcgatcagcaccggcccctcggcggtgagcatcaattcggtatgggccggcccccaggcgatgcccagcgcatcgagcacggccgaggtataggcggcgagcgcgtcctgaaccgcgcctgcgcgcggcatcagcatctccagatcgttgatgaaggcggcatcggccacctcgcgcttggattcggcccagatctcggcgatcagatggcggccgctcagactgaccgtgttgacgaaatactgccgcccgcgcaggaagccctgcaccagcagccggtcgttgaccgaccccagccggttgggccggccatgcagcgcccggaaggcacggtcgaccgccgcggcatcatggcagaaggtgacgccatccgtaccggcgctgtcgagcggcttgaccaccaccggccagtccccccgcgccaccgcccaggcaaccgcatcggccggattgtcggtcacatgctggggcgcggcggcaaggccggccgccgccaccacctgccccatcaggaacttgtcgcgccgggcccggctcagccccgtgccgttgccgggcaggcccagccccgcggccagccggtcggccagctccacgccgcattcggcccccggcagcaccaccaccggcgtatggggcagcagggcattgagcgtgcggcgaagatcgccgtcatgggcgatcagcccgatgaagtcccccggccggaagcttgcccgatagggctcggggacgaccgggctgctggagacatgaaccgtacgccagccggcggcggcgaaggcgggggcaagtgccgcgccggtcgaataggcatcgaccactaccgcaaccggcctgacatcggggcgtgacgggcgaccggtcatggcgcatcccccgcagcgaacgccgggccgctgcggcgcggccgcatcagacccagatagccggcggcgaccagcagcgccacaccggcgacggtcagcggcgaccagtggttccaggcgctgaaggcctgaaaggcgagcgtgaacagcgggcacaggccgacgatgacgttgacgtggaagatccggccatagcggatgccgacctgcagcgcataaagcggcaacgccacgcccagaaggccgatgccggcgacggtttcgaccgacggcatcggccctgccaagcggccggtggcccaggcgaccgcgccgcagaagccgaccaacagccagaagcgccgggccatgatcgccgacgggcccagccccgccagcgacagtttcttggcccagacactggtcagcgtggccgagatgccgcccgcggtggccgccaccaggccgagcgcggtttcgaccggggtggcggcgatcacctcgccctgcccctcggccgcactccaggccagcagcaggcaggcggccagaatgcccgccccgctcgccgcctcggccagggtggttcggatgcccgtggttcggatgccggcaaagcggcgccaggccagcaccgcaagcggcccgacaccgccgctcaacccgccggccaccgccggttccagccagcgcagcgccagatagatgccgagccaggcgccggccgtggtcaggttcaccatcaccagcgcccgcatcacccggggcgtgtagaccgacggctggccgccgccggcccggtcgatcacctggaacagcaggatcaccaggccgaaacaggcggtgatcagcacgaagggatcgacggtctgcagcacatggccggcatagacctcttttgcggcgctggtgacgttgtagaccatggtcgcagccagaccggccagaaccagcggccgggcatgggcatagcgatcggcgtcggcatcagtcatgcggcacccttcggcgcgcggatgttacggaacacctcgcggtagtagcggccgaaaaaggccgtataggagggctcggtatgggccagatcggcatggatgacggcgtcgatccgggccagatggcggatcggcgcattggccagccagtgatgcgacgcgtggaaattgttgccgttcacgaaccacgacaggaagcggctggtggtgatggtgcggctgttgatcagggcgctgccattgtccatcacacagccgaaatgctcgggcagctggatgtggaagttgaagatcgccgccgggatcagcggcaggaaccacagccagaggaagaccggctggccggtcagaaggtcgaaggccaccccgcccgccagacaggtcgccatcagccggaagccgtcgcgcacccgccgctcggaccggctgcggaccggcatgcggccgcgcaccgccgccagacatttgcccagcgccgcacggaagtggtccagcgccagcagattgcgccataacaaccacaagttgcggatggccgccggctgataggcgaagccctcgtcccggacatcgacgtgatggcgggcatgcgacacccgccattcctcgaaattggtcagcagggtcatggccagtgccgtgccgaccgcccggttcacccggcggctgcggaaggcgatgaaatgcatgcattcatgggcaaattccagattgcgggcatagaccgcgccgatcagcaccgcccccaggatctgcaacggcaggatgccggtaccgagggcgagccaggcaccggcaccccagatcgccccctgtcggccatgcgccacaggaaatagcggtcccggatctgcatgaagccggcatcggcgaccagctgcgcccgcgcgctggcaagccgccgctcggcggcggcggcgtctgcctccatcgccgcccgccggctggcggcatcatcaggtacggtatcaaaagccagagcggtgctcatgactgcccgtcctcgacatgagtggcgccgcgatgggtgtagacctcgtcggtggtctcgtgcaccacctcgcggctccaatcggcgacgctggcccaggcgagattgaggatggtgcgctgcgacggccgctgcagcggatagacgccatgcagcgtggtgtcggagcgcaggaaatagatgtcgccggatttgagcgcataggaccggatcggccggctgcacaggatctcgtgcagccgcggatcggccttgtcccagcgagtatcggcgacgcactggatgaagccgccatcctctaccggcggcgcctccagcacccagaccatgccataggcatagtcgtcccagtgccagccatgggtgtcgcccggctcggtcagccgggcgatgacgaactgctcgtcgtcataggggcagagcaccacctcttcgccggcgatgcgcgtggccaggtcgagcagcggcttcgaccggtagagcagcggcaccagcgcgctgttgcgggcgatgtagtcgcgcttgaccgagttcatcttccgcggcgtgttcgacgtggtcggcaggcggatgtcgcggcgcaccgcccagccggcgatcagccgctccacctcggcgcacagggccgccatcacctcgggcgggcagatttcagagacgaccaccagcccttcggccaggaagcgtgcccgccagcgggcgagcaggtcgtcggtcaccacggcctcgatctgccgggcaagcaggtcgtccagttccgccgtcaggtcgggctcggccacggtaacgatatcggcatcggcgacaggcatggatatgtcggtcaggctcatctgggtgatctccggtcgggtcatcgggatccggacgggggcgggtcttattgcgaccattcggtgggctcgcgatcccagcgatgatcgcggagggcggcgagcagatcgggcggcaggccgcggccatcggccacggcggtgttggcgcggacatgggcgggggaccgcatgccggggatgacggtgtggacatccggattggccagaatgaagcgcagcgccatgccgggcatggtctcccccgccgggaccagcggcttcagccggtcggcacgcgcgacactggcggccaggttctcgggcacgaaataggaattgcgccagtcgccctcgggccagcggctgtcgagggtgagcgtgccggtcagcgtgccctcgtcgaagggcacacgcgcgatcaccccaacatccagcgcccgacaaagcgggaacagctcgtcctcgggcgcctgatcgaagatgttgtagatgacctgcaccgtgtcgatcagcccggtgcgcagcgccgccatggcgttccacggctcccagcggttgatgctgatgccgatgccgtcgatcaggccgcgggccttcaggtcggccatggtgtcctgccaggccggatcatcggcccaggcatcctcccagacgtggaactgcatcaggtcgatgcggtcgacgttcagattgcggcggctgcgttcggtgtagtcgcggatatgatcgggcggaaacacatcggccaggcgcgatgcgcgggtcgagggccagcaccggtcggccggcgggatcttggttgcgacataaatccgctcccccggccgttcggccagcagccggccgcacagcacctcggaatggccgcggccatagatccaggcggtgtcgaggaaattgaccccctgatcgaccgccagatgcagggcggccaggctctgcgcatcctcgttgccggtccagccgccctcgccgccgccgatgccccaggtgccgtagccgatctcgccgatctgccagccaagccggccgagcctgcgtcggttcatcatgcagtctcctcggaagcggactcatcggaaaagacgtcgccggaagggtgtgggcaggcggcgcgccggcgcgcgaaccagggggcgagcaggccggcatccaccgccggccaggcgagcccggccgccgccatcgcagcgcggctggccgcatcgccgaacatcagatccttgtccgccacaagatcggcggtcgcgaaggcatccgcgccggcgtcgcccgccggatcgggcagcagggccagcagggccgccgcatcgacgtcactcgccgcggcccggctcagccgctcgtgaaaggcggcatagctgacgggggtgagcgcgatcccggcggcctctgcctcgtcgagcagatcctcgaaccgggtgccggggccgtagaggtggaaggtgccggcgggttcggtcagccgcgccgccacgaaggcggccacgatgtcgacggggctgtagtcgaagcgcagccccgtcgggaaacgcagccccagcctgaggcaggccgcggtcaagcgttcgaccagggcctgaggattgccgagaccgctccgccgggcgggcagcatctcgcccagacggtggaggctgccggtgatcccgcggcggcgcgcctcgtcgatcagccgttcggccgcccatttggaccggctgtagccgtcctgcggcagggcacggggatcggccgcatcggcctcggtcacggcatcatgaccggggctgcgcgcgaagacgctgagggtggagacctggtggacatgcttggggacgccggtcaccgccagcctgagcagggtttcgaccccggcgacattggcggcggcatgggccgcatagccatggagcaggttgaccagcgcgccggcattgacgatgacgtcgatgccctctgccagccggcgccagaccgcatcgccgaggcccagctgcggcagggccagatcgcccgccagcacggtgacgcggtcggctgcgatgccgaggcgcagagccgcggcggcatcgtcttctgcccgcaccaggcagaccagatccacatccggccgcgccagcagcgccggcagcagatgggcgccgacgaagccggtggcaccggtcagcagcacccgcacccggccggacggcggcgtccaggcggcggcccccgccgacgggcggatgtcgtccgccagtcggacctcgggcgccggcaccggggcggagccggtctcctcgccccggcggcggcggtcgatcagcgccgccaatgcacccagggtgggatgtgtgaagatgtcggcaacgctgatccgcatgccgaaatgacgggtcaggtccatggccagcaccagcgcggtcaggctggtgccgcccagatcgaagaagccgtcctcgggtccggcaggggccagctgcaatgtcgcccgccagcgggccgccagcgcggcgctggtcggatcggtgaagccggcatcggccgcggccgccgcctccagccggtcgttggcgagccgggccagggcccggcggtcgaccttgccattggcgttgagcggcagggcatccagcaccagcaaccgtgccggcagcgcctggcgcggcaggcgggtggcgaggaagcggcgcagatcggcggtatcgacctcgccatggccgatcaggcaggcgaccagttcgcgtcggccgccctgttcatgcaccaccacgcggccggcgcggatgtcgggatgatcggccagcgcgccttcgatttcccccagttcgatacgcaccccgccgatcttcacctgatcgtcgcggcggccgacataggcgagccggccgtcgcggcgccagtagccgagatcgccggtgcggtagagccggtcgccgggcagttccgggaacgggttgtcgacatgggcggccgcggtcttttcgggcgcgcccagatagccgccgcccaggcaggcgccaccgatgcggatctcgcccaccatgcccggcggggcgatgaaaccgtgatcgtccaccaccaccgccaccgtgttgtcgatcggtgtgccgatcgggatgctgcggtcgtcggcatcaccgacatggtggaagaccatgccgatcgaggcctcggtcgggccataggtgttgacgatgccgatgcccggcagcatgcgccggaagcgccgcaccgcccggggatcgatctcctcgccgccgatcagcagatggcggagcgagccgaggcgccgcaccagcccgggttccgccaccatcagatcgaccatggcgttgaagatcgatggcacgaaatcggtcatctcgatctcgtgtgccgcgatggtgcggagcgtggtctccaggtcgagcacgccgcgggtgcgcgggatgatcacccgcccgccgatggtgagcggccagagcagctgccagatcgagctgtcgaagacatggcggctgttctgaagcaccaccggcggccggccatcggcggcaaagcgccgggtcatcaccccgaaacggttgagaagcccgccatgcaggttgatcgcgcatttgggcaggcccgtggtgcccgaagtatagaacccgtagatcgggtcgcggccgtccaccgccacggcgtcgaacggggtttcggccggcagaattgcggcatggtccaggatcagcgccgccacccccggcggcaccaccgccgggtcggccgcgatcaccagccggggggcgagcgcgtcgagcagggcggcaatccgctccggcgcccagccgtcatccatgggcacgaagggggcgccgagcttcatggccgccagcatggcgagcggcagctccagcccgttgggcatcaacagtggcagcatgtcgccacggccgacgccgcgcgcggcaagcattgcggccagacggtcggcgcgggcgtcgagctcgccaaaggtcagccgcgccgtctcgtgcaccagcgccacacgttgcgggtcccggcgggcgatggcgcggatcgcatcggggatggcgggggccgtggggcatggccggcgcgggccgttgcgttcgatcagcagctcgtagcggcgtgccggggaaatgagatccaccgcccccagggcagcatcggcgccggcggcgatcaggcggtcgagtgcatgggcgagatcactcgcccgcgcctcgtcgaagggcggacggcagaggcgccggtccagaacgacccgcagccgcccgtccgcctcgaccctgagcgccagagctacagccggcagatcgccggcaggttccggaaccagaagcgcatcggccgggccttcggtcgcatcaggcgtcggcccctccgggacgagatcaccgaggcgcgcatcggccgtgacctccagcgccaggatgcgcagcccgccggcatcggccacggcgatgcgtggctgcggcagggcgcgccagcgatggaccagcacggcgagcagggccggcaaccggtcgagggggatggcccccctggtccggcacagggcctgatcgggcgccgacacagccatgtcatgcacgacggctggcacctcgggatcggtgccgtgaggcggagacggaaagggagaaggcgatgggagagaggatgataaggcgggagaagcggtttccatcacgtccggctcctgatgcgacctctgagagggcggacctgttcccgggggccgtgcggagccgggtgcgggcatggctccgccctgcgggtgttttctgcgcgacgcgacagcgcataaaacacccgttccagccctggcgggtctgtcccgccgccggtcatgtcctgttccgggttggttgtgaggtggttgaagaacggcggccgccggacatcagaggtcaggtggcatcagatgtcagatggccgcaaagctcaggcggcgcctgccctgagggtggtcagccgggtttcgatggcatcccacacatcccgttcgagcgtgacgccgtcgaggcggtcgatctcctggatgccggtgggacaggtcacgttgatctcggtcaggtggtcgccgatcatgtcgataccgaccagggtgagaccgcgggcacggagttccggccccaccgcctcgcagacctcgcggtcacgcgccgtcagcgtggtcttcaccggccggccgccgacatgcatattggcccgggcctcgccccgctgcggcacgcgcagcaccgcaccgcggggttccccctcgaccaggatgatccgcttgtcgccctcgcgcaccgccggcagatatttctggatcaccagcggctcgcgcccgcggagcgcgtgaagctccagcagcgcgccgagattctcgtcatccggcctgacccgaaacacgcccagcccgccgaagccgtagagcggcttgatcacgatgtcgccgtgttcctcgcggaaggcgcggatctcgtcgaccgaggacgacaccaggctgggcggcatcaggtcagggaaacgggtgatgaacagcttctcgggcgcattgcgcacctgcaccggatcattggagaccagcgtccgggggccggcatgctccagcaggtgggtgctggtgatgtaggccatgtcgaagggcggatcctgccgcagcagcacgacatccatctcgcggagcggaacgcgttccttggggcccagacggtagtgatcgtcgcgcacccgctgcagccccatgggccgcatccaggccactgcgccctcgggggtgaggctcagatccgagggctggtagtgataaagatcgtggccgcggcgcagggcctccagcccgagcatgaaggtcgtatcgccatcgaagttgatggtctcgatcgggtccatctgcagggcgacggtcagcgccatatgtcctccggggcggttctggagcgaccgggacggggggcagcctctccggatgcagtggcccgccagacgaaaaaactctctggcgggcaccctatcattctatcatgagttggtccaggtctgtgatcacacccaaaccgatggttttgtgaccggtcagccggggacggccggggcgtcgagttccgggtagtggcggaaaatgccgtcctggttgaaggcaagccggcggtcgctatccagataggcggcgatccgcggcagggccgccacgcgatcgaccagcgcctccacccccggccagcgcccggcaaggcccgccatgtggttggggaaagcgtagcgcaggcccagaacggtctggaacaggcccagatcggcataggaaagaccggcgcccaccagccagcccgatgcggccgggttgcgggtcagcacctgttcgtaccagccgaggaatttggggatccgctgatcgcggaagcccgccgcccggcgtgccgcctcgggcttctggtcctcgtaatagtcccaggagccgagcgggtgatggacgtcatgggcctcgttcaccagatcggcggtggtgagcgcgatctgccgcgcgaagagccgctccgcctcgtcggccggggccagcccgtaggtctcgcccagataggcgcagatcagcggcgtctgggcgatcagcagatcgccatccttcagcaccgggcaggcaaagggggcgaagggctcgcgctcatcccccagcacgcgcaaaagcccgtccatgccgccgccctggcgctcggccaggcgggccatgtcgcgccagggggcatcgatcgcgaccagcaccagacggacatattcgccccgccccggcaggccgggccaatagtagagttccatgctcatgggggtcgggctccttggctgaaccgggaaccgccccccgcccccggctcagatcaggccggcgagcggtgaggacgggtccgcatagaatttgcgcggcatgcgcccggccagatagccgaggcgcccggcctcgaccgcggccttcatggcgcgtgccatcatcaccggatccttggcgccggcgatggcggtgttcatcagcacgccgtcgcagccgagttccatggccaccgccgcctccgagggcgtgccgacaccggcatcgaccagcaccggcacgcttgcctgctcgacgatgatccggatgttgaccgggttctggatgccgagccccgagccgatcggcgccgccagcggcatgatcgcgcagcagcccagatcttccagcttcttcgccacgatcgggtcgtcgctggtgtagaccatgacgtcgaaaccgtcgcggatcagggcctcggcggccttcagggtttcggtcacgtcgggatagagcgtcttatggtcgcccaggacttccagcttgaccaggttccagccgccggcttcgcgcgcaagccgcagcgtacgcacggcatcgtcggcggtgaagcagccggcggtgttgggcaggtagacgtagcgcttcggatcgacgtaatccatcagcatcggcgccgacgggtcggtgacgttcacccggcggaccgccacggtcacgatctcggcgcccgaagcttcgatcgcgcgggcggtttcctcgaaatccttgtacttgccggtgccgaccagcagccgcgaggtgaaggtccggccggcgacgacgaaaggatcttccacgggggccacagccacgtcggcgccgctgccgccgccgatgaaatgcacgatctccagccggtcgccgtcggcgagctgcgtggtgtcgaacgcggcgcggcggacgatctccagattgcgttcaaccgcaatcttccgcgcatccagccccagctggcccagaagcccggcgacggtcggctcgcctgcaacctcgcgggcctcgccgttgatcatcagtcgcataccaggatctccgctcgatatgatgctcgggccccggggtggcggaacgcccgcttcgaacggcgttgcgccccgcggcacgggtgctttataacgcagggctgacgtggcgtcctctcctaatcaccgttcacggggtatcgacagcccgcatggcgccgaccatcctggtcctgaacggaccgaacctgaacctgcttggcacccgcgagcccgaggtctacgggcatacgacgctggacgacatccggcgtctgtgcgaagcccgtgccgcggccctggggctggcggtcgatttccgccagtcgaaccacgaaggcgttctcgtggactgggtacaggacgcccgcacctctgcggcagggatcgtgatcaatccagccgcctacacccatacctcggtcgccctgctcgacgcgctcaccgcgacggcactgccggtgatcgaggtgcatttgtcgaatatccatcgtcgcgaaacgttccggcatcattcctatgtgtcccggacggcggtcggcgtgatctgcggcctgggggccacgggttacgcgctggcgatcgaggcgatggccgggctgatccctgggggacaggcccgcgcggccacgaaggaccaatcgcatgtctgacaccaaggctcgtgccgtcgataccggcctgatccgcgaactggcgctgctgctcgacgagaccggcctgaccgagatcgaggtcggcgcgggcgagggtcgcatccgcatcgcccgccaggcgccggcgcagatgaccgccccgcagatgctgttccaggcgcccgccgccgcggcccccgcggcggccccggccgccgcagcccctgcggcaccggttgcagccgaccccgccagccatccgggcgccgtgccctcgccgatggtgggcaccgtctatctggccccggaaccgggtgcgccggccttcgtcgccgaaggccagagcgtgcgcgagggccagaccctgctgatcatcgaagccatgaaggtgatgaaccatatccgcgccccgcggagcggcaccgtcagccggcttctggtgcagaacggccagccggtggaattcggcgagccgctggcgatcatcgagtgacgcgggagcgatcatgttcgagaaggtgctgatcgccaatcgcggcgaaatcgcattgcgcgtccatcgcgcctgccaggagatgggcatccgcaccgttgcggtccattccaccgccgatgccgatgccatgcatgtccgtctcgccgacgagagcgtgtgcatcggcccggcgcccgcgcgcaattcctatctgaacatcccggcgatcatcgccgccgccgaaatcaccggcgccgaggcggtgcatccgggctatggcttcctgtccgagaacgcccagttcgccgagatcgtcgaggcccacggcctgaccttcatcggccccaccccggaccatatccggctgatgggcgacaagatcgaggccaagcgcgcggccagggagctgggcctgccgctggtgcccggcaccgacgggccggtgacggacgaagccgaggcgatgaagatcgcccgcgagatcggctttccggtgctggtcaaggccgccgccggcggtggcggccgcggcatgaaggtggccgaaagcgccgagggcctgcgcgaggcactgcagaccgcccgcgccgaggccaaggccgctttcggatcggatgcggtctatcttgagaagtatctcgcaaatccgcgccatatcgagatccagatcctctgcgacaccttcgggaccgtggtgcatctgggcgagcgcgactgttctctgcagcgccgccatcagaaggtgctggaagaggcgccgtcgccggcgatcgatgcggccgaccgcgcccgcatgggcgagatcgtcgccaatgccatgcgcaagctgggctatcgcggcgtcggcacggtggagttcctctacgagaacggcgagttctacttcatcgagatgaacacccgcctgcaggtggagcatccgatcaccgaggcgatcaccggcatcgatctggtgcgcgagcagatccgggtcgccgccggccagccgctgggcttcacccaggacgacgtgcgcgtccagggccatgccatcgagtgccggatcaacgccgagaactccgagaccttcgccccctcgccggggctggtcgacacctatcacgccccgggcgggctgggggtgcgcgtggacagcggcctctatcagggctatcgcatcccgccctattacgacagcctgatcgccaagctggtggtccatggccgcaaccgcaacgagtgcatcatgcggctgcgccgggcgctggaggaatatgtcgtgggcggtatcgacaccaccctgcccctgcatcagcgcatcgcccgccatccggatttcgtcgacggcgtctacgacatccgctggctggaggccctggtcgccaatcgcggctgatccgggaccatcccgcatcaaggggcgggcgggccggaggcgtttccggcccgcccgtctgcgttttaccggagcccaccctctcccggagccctgccatggccggcctctcccccgatctgcagaccccatgccttgtggtcgacgaggcgaagatggcggcaaatatcgaccggatggcccggcggatcgccgggctcggcgtgggcttcaggccgcatctgaagacggccaaatcggtggagatcgcccggcggatgctgcccgacatgggcgggccggccaccgtctccacccttcgcgaggccgaggtcttcgcggcggcgggcgtgcgcgacatcctttatgcggtcggcatcacgcccgccaagctcggccgggtgcaggcgctgagggcccggggctgcgatctggcggtgatcctggattccgccggacaggcgcaggcggttgcggcagcctctgccggggccggcccgatcccggtgctgatcgagatcgactgcgacggcaagcgtgcggggctcgcccccgatgcggcggagatcatcgagatcggccatatcctgcacgaaggcggggccgacctccgcggggtgatgacccatgccggcggcagctacgacgtctcgggcgcggacgcccatgccgccttcgccgaacgcgagcgccgggcggtggtgacggcggcagaccggctgcgcgcggccggcctgccctgcccggtggtcagcgtcggctccacccccacggcgcttgccgcccgcgatcttgcgggcgtgaccgaggtccgcgccggggtctatgtctttttcgatctggtgatggccgggatcggcgcctgcgcggtagacgacatcgcgctctccgtcgccaccaccgtgatcggccaccgccccgaccggggctggatcctggtcgatgccggctggatggcgctgtcgcgcgatcgcggcacggccggccaggcggtcgatcagggctatgggctggtgctgactgcggatggccgggtgatcccggatctgatcgtcaccggcgccaatcaggaacacggcatcctggccctgcgtcccggtgcggcggccacgccgccggagctgccggtcggcacgctgctgcgcatcctgcccaaccatgcctgcgccaccgccgcacagttcgacgcctatcacgtcatcccggcggatattggcgccgccccggcgatctggccgcgtttcggcggctggtgatccggcgaccagtgacacggcgatgattcacggctcctgttgaagggaggccaccgggtcccgatctggaaaggtgacgcggctgccctttgtcagccggattgcccattcacgaccggaaccgcaccctcttgtccacctctcccttcgatcgcctgggcctggaagcccgccgtcttgcccgccgcctgacgcctgaggcgctggcagaagaggcggcgtctctgctcgaccggccgctccggctgggggtgaccggtcttgcccggtcgggcaagaccgtgttcaccaccgcggtcgcccgcgccctgctgtttcccgaccgcttgcccttccttcaggcccgcgccgatggccggctgatcggcgccgagctgcgccggccgggcgatcccgagatcccgcgcttcgcctatgaaacccatctggcgcgactggccggcagcgatggcgagatgccgggctggcccgcctccacccgcatgctctcgcaactacgcatggggctgcgctggaaaccggccggcatggtcgaccggcggatcaggcctgtacgcgagctgacgctcgatatcatcgactatccgggcgaatggctactcgatctggcattgatcgagcgcagcttcgccgactggtcggccgaggctctggccacgctgcgccaggggccacgcgccgagctggcccgccccttcctcgcccggttggaaaccctggatccggccgccccggccgatgacgtgacgctcgccgaactcggccagggctggagcgcgcatctgattgcctgccgtacggcgggacttgccgtctcgcgcctcggccccggccgttttctggtgccgggcgatctggaaggcgcgccggtgctggccttctcccctctgccggaacccaaggggcgcgtgccctcgggcagtttgtatgccgtggcggcggagcgtttcgaccagtatcgcaagcgcatcgtcggccgcttcttccgagaacatttcgcgcggctggaccgccaggtggtgctggtcgacctgcccggtgcgctcagcgccggggccgatgccgtggaggatctgaagctcgccctgaccgaaagcctgggcgccttccgctatggccgcggccacggcatgatcggccggctgctgtcgggcgtgcgcatcgaccgggtgctgttcgccgccaccaaggccgaccaggtgccggccgcccagcatgcccggctggacgcgctgatgcagtcgctggtggccgatgccgcgcgcgcgatccgcttcgagggggccgagacccgcacactggccatcgccgcggtcaaggcggcggaaagcgtgttcgccgagcatgacggccgcaacctcgcctgcgtgcgcggccgcatcgccggccgcaagcggccgtcggtggtctatccgggcgagttgccggccgatccggccgaggcgctggcccgggccgccggtggcggtttcgacttcccgcccttcctgccgcccgagggtctggtccgcgacggccatggcatggcccatatccgcctggatcaggcgctggatcatctgatcggagaccggctcggatgaccgaccgcccgcgcattttcgacgaaccggccgcaacgccgccccgccgtccggcagccgcccatgcggcagcgtcgggcccgctggagctgcccgaagcggccgccctgaccgcacggccggcagaggaggcggcactgcccgccacagtgcccggccgcgggctgatgccggatctggcgcccggggccgcgacgcgccgcaccggccgccggctgctctggggcgggctcggcggccttgcggtggcgctgatcggcttcgagacctgggatctcgccacccgcgccttcgcccatgccgactggctgggctggatggtcaccgggctcggcgtcgccacgcttggcgggctcggcattctgggcggcgccgagattgccgccctccggcggcttgcccgggtcgacgggctgcgggacgaggcggaacggctggtggcaccggatgccctgcacgaccccgccgcggccgccgatgccgcggccctcgccgcccgggtcgcggccctctacgaggcccggccggggcttgccgccgcgcgggccgatttcgccgcccaattgaccgatgcccatgacgccgccgaggccctggccctgaccgaacgcctgctgctggccccgatcgatgccgaggcgcggcggctggtgctgctggccgcccgcgacacggccctggcgaccgccgccagcccggcggccctgctggatgccgcggtggtgctgtggcgcaatgcccggctggtgcgcgaggtggcggcactctacggcgtgcggcccgggcggatcgccagcctgaagatcgtgcgccgcagcctgggtgcggccgccgtcgccggcatgggcgaggccggccaggataccgccgtcgacgcgctgggcggcgggcttgccgccgcggtctcggcccggctgggccagggcgtggtcaacggcctggtcgccgcccgcatcgggctcggcgccatggaagcctgccgccccctgcccttccgggcagtgaagcggccgcgcaccaccgatctgcgccgcgacatgatgcggatgctgacgggcaactgacggctgctcttgccacccggcgccacggggtgcaggttgggtgccggctgcaggtcagggaccggggcgacgttgaggaacgcggccggccaccccacatctggagcagtttcctccccagggacatccggcatgcatctgacgcccgacctgctgctgcgcgcctatgtctgcggcatcttcccgatggccgagtcgggcgacaaacccgaactctactgggtcgaccccgaccggcgcggcgtgctgccgctggatggctttcacctgccgcgcaagctgcgcaagactatccgccgccagccgttcaccgtgaccgtggatgccgatttcgagggcgtgatgcgcggctgcgcgacccctgcccccgggcgcgagcggacctggatcaatgacgagatcctgacgctttataccgagctgcaccagatgggccatgcccacagcatcgaggtacgggagggcgacgagctggtcggcgggctgtacggcgtgtcgctgggagcggcgtttttcggcgaaagcatgttcagccgccgcaccgatgccagcaaggtggcgctggtccatctggtggcccggctgaaacgtggcggctatcggctgctcgacacccagttcgtgaccgaccacctgacccgcttcggggcgatcgagatcccgcgtggggtctatcaggaccggttgcgcaatgcgctgggcatcagggcgagcttcatccccgagcctttcggtttcggcgcgggcacgcccgatcaggtgctggcggcgatcgacggcccggtggcacagccccggcggcggcggccgcgcgatccgatggacgatgccgatgcggtggtggtggaggtctgagcgggatcagcccgcgggcttcgcggcgccctcgtccgacggctccggcgccttgtcgacgcaggagatcggccagatatcgtagatcgggttgtcgagtgcgttcagacccggcgaggaggcgaacatccagccgtcgaagatccgctcggtcggtgccgaagcggtggtctgctgcacttccaggaagacccgggcctcaggggcctgttccggcggcgcgctttcgcaatagcgcacggtgatcaccagcgagccgaattcgaccggctggtcgatgggcgccacgatccggctgatccgcgccgtcaccttgttcaggccgttgaagatcgcgaccttgcccgggatgccgcccgttccacccgtctgctgctgcgcggcggcagggcccgaggccagaagcagggcgccgagcgccacggtcgcaaggctgcgcatcctgatcattccgcgaacggatccttcttcgccgcaccgccggcggcgggggcttcggcaccggccggcttctcctcgccgctgccgccggacgagaagagatagcggccgatcagcgattcgaggctgaccgaggactgggtataggtgatcgcctggcccggctgcagcatgcgatcatcgccgcccggcaccaccgagacgtatttgtcgcccagcaggcccgaacttgcgatctcggccgagctgtcggccggcagcttgatcgtggggtcgatcgacagcgtgatctcggcgcgataggtctcggggttcagatgctggccggtgacgctgccgaccttgatgccgccgatgcggacctccgagccgggcacgatgccgtcgacactgtcgaaagcggcggtcagggcatagccactgccgctgccgccgcgcccggcgccggtataggcatggacggcgaagccgaccgcgaccgcgatgacggccgcgccgagcagggtttcgacgacactgcgctgcaagctctgcttccttccggccgttggatccggatcagctgcgacggccggcgacagtgccggccggcagatacccgatcagatcaggacggcgtccagggttcgtagtcaccggtggccttgggccgctcgccgccggccaggatatggcccttgggcagataggcttcggcgctgccggtgtggttcggctcgaacggcttttcccaggtcttgcgcgccagcggcgcctcgaccggggtctggtcggtggtgccgtgcagccagcgatgccattccggcggcaccgtggtcgggtcgacacccttgccataggtcacccagcgcttggacgggttgtccttgtgccggaaataacggttcccgaactcgtcctcgcccacggacacgccgtggcgcagggtgtaaagacgtgtcatgagattggtcatggggtccactatccggatgactggccgccgccaagataggggttgccccccgggtgcgcaagcctcggccgtgcagggcgggcatatgtgccgtgcaggggtggccgcggcgctgcattacgcatcgatgacagccatcctgtccacaggccgcttgtggaaaagcgggggaagaatcgcccggttccggcgcggaatcaaggccctccggggctttgcgcgaatgctgtgcgaagtcccggacatggcgggcttttccatacatgaccacaccatatagataaaatcccccgcaagaccccctagatattgtaaggcagggtgctcggaaaacacttgcggcgcggggccgtacaggcttacgatccgggtcagacgggcagaccgaagacatcttcctcggggatcccgccgcagatttggcgccggtccggccggcgaccttcggacataaccccaacccgacagacccgacccccgacaccgcaccccgcgcgcccaggaacgaaccgatgcagtcgatgcgccggtggccgggcttcggggtgtttccgtgcccggggcgtcgttgcgtcgccattttccgttgaatcccacgcgagcgggcctcaagccgcccgccagcatgatggaggcaggatacgatgcggatcgcccgcaagctcaccgtcgatggccgctccccttaccaggggatcgagatgcggaccgccaccagcgaaatccgcaaccccgacggctcggtcgtcttcaagctcgagaatatcgaggtgcccgcctcgtggtcgcaggtcgcctgcgacatcatcgcgcagaagtacttccgcaagcgcggcgttcccgccgtcacccggcgcgtgcccgaagagggcgtgcccgagttcctgtggcgttcggaacccgacgaggcggcgctggccgccctgcccgagggtgagcgctataccggcgagcgcaccgccgcccaggtcttcgaccgtatggccgggacctgggcctattggggctggaagggcggctatttcgacagcgaagccgatgccgccgcctatcgcgacgagatgtgccggatgctggccgaccagatggcagcacccaactcgccgcagtggttcaacaccggcctgcactgggcctatggcatcgacggcccggcccagggccattattacgtcgaccacgtcaccggcgagctgacccgctcggccacggcctatgaacacccgcagccccatgcctgcttcatccagtcggtctcggacgatctggtgaacgagggcggcatcatggacctttgggtccgcgaggcgcggctgttcaaatacggctcgggcaccggcaccaatttctcgtcggtgcgtggcgagggcgagccgctgtcgggcggcggccgctcgtcgggcctgatgagcttcctgaagatcggcgaccgcgccgccggcgctatcaagtcgggcggcaccacccgccgggccgcgaagatggtggtggtcgatgtcgaccatcccgatatcgaagcctatatcaactggaaggtgatcgaagagcagaaggtggcggcgctcgtcaccggctccaagctcgccaacaagcatctgaacgcggtgatcaaggccgcctcggatctgaaggtggccgaggacgaccgcttcgacccgcgccgcaacccggcgctgaaggccgcggtcaaggccgcccgggcggcgctgatccccgagaattacgttcagcgcgtcatccagttcgcgcgccagggttataccgaactccatatcccggtgttcaacaccgactgggattcggaagcctatctgaccgtttcgggccagaactcgaacaattcggtgcgcgtcaccgatgccttcctgaatgcggtgctggccgatggcgagtggacgctgacccgccgtaccgacggcaagtcggtgcgcaccatccgcgccaaggatctgtgggagcagatcggcaacgccgcctgggcgagcgccgatcccggcatccagttcgacaccacgatcaacgactggcacacctgccccgcccacggccggatcaacgcgtccaacccgtgctcggaatacatgttcctcgacgacacggcctgcaacctggcgtcgctgaacctgatgaccttccggcgcgaggacggctccttcgacatcgagacctacgagcatgcggtccggctgtggaccgtgacgctggaaatctcggtgctgatggcgcagtacccctcggcgaccatcgctcagctgtcctatgatttccgcaccctcggcctcggctatgccaatctgggcggcctgctgatggcctcgggccttgcctatgacagccacgagggccgcgccctgtccggtgcgctgaccgcgatcatgaccggtgtcgcctatgcgacctcggccgagatggcgaaggaactcggcacctttccgaaatacgcgcccaatgccgaggcgatgctgcgggtgatccgcaaccatcgccgcgccgcccatggggcgagcgagggctatgagcagctgtcggtggccccggtggcgctggaccatgccaacctgcccgatccgcgcctgggcgatgccgcccgccgcgcctgggaccaggcgctggaactgggcgaggcccatggtttccgcaacgcccagtcgaccgtgatcgcccccaccggcacgatcggtctggtgatggattgcgacaccaccggcatcgagcccgatttcgcgctggtgaagttcaagaaactggccggcggcggctacttcaagatcatcaaccgcaccgtgcccgaagcgctggcgaagctcggctatgaagagccgcggatccgcgcgatcatcgactatgcggtcggccgcggcacgctggccggctcgcccgccatcggccatgacgcgctgcgggcccgcggcttcgacgatgccgcgatcgagcggctggagaagtcgctgggccaggccttcgaactgaaattcgccttcaacaagtggacgctgggcgccgagttctgccgcgacgcgctgggcttcaccgatgcccagctcgacgacccggctttcgacatgctccagggcctgggcttctcgaaggacgagatcgaggccgcgaacatctgggtctgcggcgcgatgacgctggaaggcgcgccggggctggaagcccggcacctgccggtcttcgactgcgccaacccctgcggccgcaagggcacccgctacctgtcggccgaagcccatatccgcatgatggcggcggcgcagcccttcatctcgggcgcgatcagcaagaccatcaacatgccgaatgcggccacggttgaagactgcaaggcggcctacatgctgtcctggcgcctgggcctcaaggccaatgcgctctatcgcgacggctccaagctctcgcagccgctgaacgccatgatcctggacgacgatgtcgaggacgtggaagaggcggtggccgagttcgcagccaggcccgccgccgaacaggcgcgcgtggtggccgagcggatcgtcacccagtatatcagcgagcgccagcgcctgccccatcgccgcaagggctatacccagaaggcggtggtcggcggccacaagctctatctgcgcaccggcgaatacgaagacggcaagctgggcgaaatcttcatcgacatgcacaaggaaggcgccgccttccgcagcctgatgaacgccttcgccatcgccatctcgatcggcctgcagtacggcgtgccgctggacgagtatgtcgacgcctatgtcttcagccggttcgagccctcgggcatggtcgaaggcaatgacgcgatcaagatggcgacctcggtgctcgactacgtgttccgggaactcgcgatctcgtatctgggccgcaccgatctcgcccatgttcagccggtccaggccgccgacctgctgcccgacagcgtgggccgcggcgtgcgcgagggcacccgcgaagatggtcagggcggcacgcccgtcccggcgccggcggttgccgcggccatggggctcgccagcgccggcttcgtgcgcagcaatctctacgtgctccgcggcggcgccggcggcaacaccgccactgcctatgccgagccccacgaccatgcccatgcgcatgaagacctgtcgccgaccgccatcggccgtgccgaagtggtcgacgagcgcctggaggcgatccgcatcgcccgccagaagggcttcgagggcgacccctgcggcgaatgcggcaacatgaccctggtccgcaacggcacctgcctgaaatgcgtcacctgcggctcgaccagcggctgctcgtgaccggccgggcggcccgcccgcccctgcctgcatcccgatgaccacccgacgccgccccggttccgaccggggcggcgttcggttttggtggcagcggcggcccgccatgcctagagtcagggccatggcccacgacatcgccccacccgccctcatcgtcccggccgagtatcccgaactccggctgctcgcctggaaccgcgatccggcacgaccactgccggaagcggaagtttttgcgctctacgaagccaattggcgccatgtcgaccaggaccgcctgacgccccgcgaacgggcgctgatcgaccgcctgacccggcgctggggggccgggcggatgctggtccgatgaccggctatcgtcgccccgaacatcaggccgtcgccgttttgctcgatcggctggacgcggcggttctggatgcgggcgcctgccgcttcggcggcggcaccgcgatcgtgctggcgcttggggaataccgggtttcggccgatgtcgactttctctgcgccagcacggaagggtatcgcttcctccatcagcgcatcttcgacggcggattcggaagcctgttcagagcccccgtcaccctgcctcgcggccaccgcgccgatcagtacggcctgcgtgccctgatcgagatcgacggccggccggtgaagttcgaaatcgtccgcgaagcccgcatcgacctggatccgccagatgcccggctgtgcggctgtccggtgctgacaacagccgaccagtacgccgaaaaactgctcgccaatgccgaccgcgaggcagacaaagccgtcgcctggtgggatgcgatcgatctcggcatgctgatccagcatctgggccctgtcccggatgcagcggtcacaaaggccgtcggcgcctacggcccctcggtcctggccgccctctcacgggttcacgagacgctcgaccttccggacaaccgccgccacgcctgcgaccgcctgggcatgaccggggaggatctggacagggccgtcgatgcgctcggcgccgacatccggcggctgacgggcggctgatccgttcaccccgcctgcggcgagcggcggacccggatctcgatccggcggcgttccttcacgtcgcccgattgcgagccatcggcgagcacatcgccgggcatgatcgtctgcgcgcctgaatagggcaggatgcgcagttccgagagccggggatccgcccgcaggatgcgggcgaccgcggccgcacgggccatgcccagcccggcattgtcccctggacgaagccggccggcaccttcgctaccacgcagaaccggcagcaggctgcgatccagatttgactggcggccgcccatgccctgctcgtcggtatggccgatcacctcgatcacatcggtgccgtaacggcccgaaatctgcaccagctgctcgaccacagccgtggacagaagcgtccggaactccggcgaaatctcggcactgccgatcccgaaggaatagccgtctgcttcgctcaggctgatgatcggcggccagtcatgtgccccgcgcccgagcagacggtcgagcataccgggcgccgcatcggtcttcggggcagtctccgccgtgcgggctccggctgcaagccgcgcaatctcgtcgggcgtcatcccgaccagatcctgttccgcgcgggcagcgtcgagcgcccgggcctcgtcgatcaggcgggccagctcttcaggcgtgataccggctcggacataaggggcgaggtcgcgccaataaggggcgatttcctgcacctccggcacggtcatgccggtctccgccagctggcgggcggttgccgcgccaatagacagctcgcgccagtcctcgggcacatccgggcgcgcctccagcatccgggccatcaccgatccctcggcatcgagttctgcgaccttgagccgcgcctcggcaagctccgcctgaatgcgcgaaatggtgcgggcgtcgcgggtgaagatcacggcggagatcagcgccagacagaaaaccagcaacagcatcagctctgccatggtcaggccaagcacgatgccgcgacgataggaggcggcagaacgccgcatgccgccatccggtgcgtcgctcatccgccctgccccacgggtcgcgcgtcatccgccgtctggaaggtttctgccgatgccacaggcaccgcctgcacgtgatcgcgggcggcaagcgcggcaagcgcctcggcgatccggcggttgccggcctcggcgcgctccattgcctcggcgagccggcgcagcccgtcccgggtctcgcccagaacctcatctccggcggcctcccgcgcccgggctgctcgttccacctccccgatcgcccggatcagcgcctcggtgttcccgtgcgacgcccgctcgaaacctgcggcagccccggccagcgcatcgacggtcggctgaagctggatccggatcagctgttccggcgtctgcatcgcgcgcagccgctcggccgtctcacccaggctgctggtcacccggccggcgctggcggccagcccgtcggtgtcctcggccagacggcgggtgacgtcgccgagcgaggcggacacccgggtggtaagtccgtcgagcgtggcactcgacgattgcgataccgcctcgatcggctgcaccgccttctgcacggcggtctcgacctcggcaagcagccgttccgacaccgtgcgggtggtattcagaatctcctcgaagccttctcccatcacctgttcagtggcacggcggaaatgggagagttcgagcaccgtccggtccagctcgcgccgcagcttccgggcagcgtcggcaagttcgatgcgggcggtatgctcgacttcgatgggatcgacccgcatctgattgaacatcacccggagcgccaccccggtaatggtcgaggcaatcgcgatgccgaaattgcgcacgatctcgtcggccgcaccatcggcgctgaactggtagagcgaggcccccaggctgaccagggtgtagagaaagcccatatagtaaagattgtcgccgttctggtcagcgcgcagccggagcctgcggaagccgagcagggccgctgcatagcagagcatcaggaccaccggcacgcccgtgaccaccccggcaggcaggcccatcagcttcgccgccatgatgaagccggcgcccgcgatcacgaatgcaaagaacacgatcggcccaaaggccgtgtcgagacgcgtgccggacattcagccagccccctgcagcttatggaccgggccaggccggcccaggttgtcaacgatccactgaccccagaagcggacatgttccaccgatctgaacctcgatgtcgcacgctcgatatagaacagcgtcaccgaggcgtccttgagatcggtgtggtactgcctgtatgcaggggatgccctgaaggtgtcgtagcgcagatccccccggaactgcgaatagagcggtgtgttctcaaccatgtcggacacgatcaccagggacttaggcaaatcggctacggcctggcccgcaaagctgtcgaccgcgatgccctggatggccgacatgatcggcgagacatcggcggtatgcggcgccaatccggttcccagcgcctcggcaagcggccgttcaaaggccgtgatccagcgcttgcgagccagtgccggattggcggtccattcgtcgagatcactgccatcgcccggattgcagcggctgaacagcgaccgcgaaccgccgttttcgggtgtcatcaccctcagatcgatgcgctcgttcaccgcggcacgggtcgcgatatcggtgagcagggtcttcacttcgcgccgcccgatctcaggcagcgggtcggaactgtcgatcaggatcacggtgatgccggcaagccgtccgtcggccggacacaggctctcagggtcgcgcttcgtcggacgttcggcgccgaaccacagccagccgccggccccgaggatgacgaggatcgccaccaccgcaagaacgaggccgatgacggtgccggtctcgccgcggccgccgcgccgcctacgccgccttgccatcccccgcctccggaatcagggtgtcgagctgtcgataacgttcgaccgtgtcggcgaaagcgcggttgatgtcgacgatcgcggcttccagcgtctgctgggcgatccggatctgctcgttcagcaggtcgcgatctccctcgtcccgccgggggatggcggcaggaatgcgcgtcagggtgaagccccggacgaaacgttccggcgacggcgtgctccgcgccgattggttggcggcgtggtagatccgaagcagcgcggtgccggcagcctccagattgacctgcgcctgttcgaacagcagctggagacgctggcggttggagatgatcgtgtcgtagtccttgcgccgttccgagaggtcgcggctcacctcccccagcttttcgccatagtcgcggcggatgtcgtcgagcgtgtcgatcagcgcggtcttgcgggccatataggcatcatgggcggcattcagccgcgcctgcacgccggcatagcccggataggggtcgcggaactgccagccatcggcgaaggcaagggccgagaacagcagaccgatgccgaacaggatccaggactggatgtcggccatgacgaagggcgccgtgccaagccggcgcatcacctcctgcccggccccttcggcgacgagttcggcagcctcgcggtaatgagcgagcgccagattgatcgccacggccagcaccagatagatcagcagcgagacgacgcccacggccttcaccgccccgttgcggtgggcgaggcaggagacgccccagaatgccaggaagaaggccacgccgatattgagcgccgcaaagaagaaggcctgcgatgcgccgcccagcagaccagcctggttgccgaccgccagaaagctgccattggcgatggtctcgaccagcagcagcagcgcgatcaccgcaacggacagcccgcgccggagcggcgtgtgcagccgggctgcacggtcgatgccatgacgggcacggaaggcgttgcgttccgcctcggcctccagcacccggcggcgcagcccatgcagctcgtccatgcccttcgccgcctcggcccgaaattcggacagacattcaggcgccgcaagccggatctcgttgaaccgttcctcgaaggcgagcccggccaggcgctccgaataggtatggacctgttcctcgaaggtctcgaaagcacggccgttctgggcggcaacctgctcggcaatacgggcctcgacatcgtccgggaccaggctgtcagcgggcggctcctcacgcgcgccacgcgcacggccctcggcctcaagccggaggtcggtcgccacccgggtggcgtcgagttcggtgaacacctgcaacgaggcacggttcagatggaccgggcgatgcaggctcccggtcagacggctcaacgccgatttcagcatgatggacggaccgtcccgctattcgtccggccatcagcccgtcggccgatccgacggacacgattcgcccggaacgtgtgttctgcatcgaattatatgcagaaacgccagggtccggacaaccggctgtcggcagaggtcgctcaacgcaacagcttgagactgccggtcagcgatcggacccatttgccggggccgacgaggccgacgccgtcgatcgactcggtgccgaggtcgcggtcggggaaggcggcgacgtagtcagcgaagacgtgcaggctgcgggcgaaggccgggaacgggacgaccaccgcctcttccggggccggcagggctttcagcagcaggccgcggatcacctccgccggtgcctgaaggacggggaccggcaggttggtgatcgtggccgtgcggcgaccggccgcatcggtcagggcgacggcgccgagggccggccgggcagaccccaggccgatggcgatgccggcgatggtgttggcaagcaggccggccggcagggccgggtcgatgacgatggcgatgcgtgtgtcggcggcagtcatccggggatcccttcgcatgaggacgggatcgggcctccgcccgctcccggtcgcgaagtctgggcggccgccgcgggaatgtgctgtctatccacccgccggcagagggcgcgtggggcaggatcattccagccccgtgcaaatcaaggcagaagcttgcgcaccaccgggagtggtgacggcccatacgatcgcaatcacgcccgagataatggtataccagttcggaatcaaatcgcccggatccaggatgtcgccatgcacaatatttcttgtgcagcgcaatatcgttgcgatccggcggtcggtatcagatccgaagggttcttccggaaataatcgggatcgcgcaccggttcggggatcgcgaaacatgcggcccaaacctcggaatcgacaccgttcgctctggtagggtttcacggttgccagcgcgcgacggtttggttacttaggtccggagccttcaggggaggcccgcggaggggctgcggtgctgggggagaattgatgcaccgcacgtgcttccgaacacgttacggctggacgcgcgaaaccacagcgcgcagcattccatcagggcaaccgccgtccggccgtccggcccccgcgggacgatcggtgcggcatgcggccaacttcgacatatggaagcgatgtcggccttgatttccgtacagaacatcgtgaagcgcttcggcgggctcacagccgtcgacgactgctcgctggacgtgccgaaaggttccatcaccggcctgatcgggcccaatggtgccggcaagagcacgctcttcaacatcatcgccggcgccctgtcgccctccagcggcaaggtgctgctggaagggcgcgacgtgaccgggctcaaaccccaccagctgttccggcaggggctggtgcgcaccttccagattccgcacgaactcggtcggatgaccgtgctcgaaaatctgatgatggtgccgcccggccaggcgggtgagaacctgatctcggcctggctgtcctggggacgggttcagcgcgaggatgcgcagatccgccgcaaggcgatggaggtgctcgacatcctcgagatcacccatgtcgcgggcgagctggccggcaacctctcgggcgggcagaagaaactgctggaactcggccggaccatgatggtcgacaactgccgggtgatcctgctcgacgagccggcagcgggcgtgaaccgcacgctgctggtcaagctggccgatgtgatccgccggctgaaccgcgagcgcggcatgaccttctgcatcatcgagcacgacatggacctcgtgaccgagctgtgcgacccggtcatcgtcatggcccagggcaccgtgctgacccggggcaccatggccgagatccgcgcgaaccagacggtgctcgacgcctatctgggctccgccggcgatccggaagctttccgccgcaaggcgtgacgcagcgaacgaggaacagatgagcctgctcgaagtcgagggcgtccgcggcggctatggcgaagtggacatcctgaacggcgtcaacatgcgcgtcgaggacggcgaaatcgtcgtcatcatcggccccaacggcgccggcaagtcgacggccatgaaggcggttttcggcctggtgaagatccgccagggccatgtccgctttcagggacacgacatcaccaatctgcggcccgaccgcatcgtccatcacggcatgtgctacgtgccgcaggaaaacaacgtcttcccgacgctcaccgtccaggaaaacctggagatgggggccttcatccggcgcgacgactatcgcccgaccatggagcgcatctacgatctcttcccggtgatgcgcgagaagcgcaaacaacccgccggctcgctctcgggcggccagcgccagatggtggcgatgggccgggcgctgatgctggaacccaagctgctgctgctggacgagccgaccgccggccttgcgcccgcaatcatcgaccagatgttccagaacatcatcaagatcaatgaactgggcgtcggcatcctgatggtggagcagaacgccaaacaggcgctggccatgtcgcatcgcggctatgtgctggtccagggccgcgaccgcttcaccgataccggcgcggcactgctcgacaatcgtgaggtggccgagatgttcctgggcggcggaggccacgcggaatgaccgatctccttcagctcaccatttacggcatcgtgctgggcagcatcttcgcgctgggtgccgtgggcctgtcgctggtctatgcgatcctgcgcttcccgcatttcgcccatggcgacttcatgacgctgggtgcctatatctcgctcgccatcgtcaccaccttcggcgtgccgccgatcatcgccctgcccttcggcgccgccggtgcggtgctgttcgccattgccgtcgaccagaccatctatcgccgcctgcgcaagacccagccggtcatcctgctgatctcgtcggtcggcaccgcgctgatcctgcgtgccctgctgcagatgatcttcggctcggaaacccaggtctaccagtcgggcatccagatgccggtccgcttcggcgaccttcgggtcaagccggcgcatttcatgatcgtcggcgttgcagcggggctggtgctggcgctgcacctgttcctgcagaaaacccgggtcggcaaggccatgcgcgcgatgagcgacaatcgcgacctggcccaggtgaccggcatctcggtcgaccggatcgtgatctggacctgggcgatcggcatcgcacttgccgccaccgccggcgtgctgctgggcatggacacccgcctgcacccgaccatgggctggaacatcctgctgccggtcttcgcggccgccatcctgggcggcatcggcagcccctatggcgccatcgccggcgggctggtgatcggcatcgtccaggaatggtcgaccatggtgatctcgcccgcctataagccggcggtcgccttcgcgatcatggtggtcatgctgctggtccgcccgaccggcctgttcgcggggaggaaggtgtgatgatgggtatgggtggtcttgaaacctatgcggtcttctttctcacctcggtcggcatctatgccatcgtctgcctggcgctgaacgtgcagtggggcctgtcgggccagttcaatttcggcatcgtcgccttctatgcccttggcgcctatacctcggcgatcctgaccggacccgacagcggcggcagctatctgggcggcttcggcctgccgctgccgatcgggctgatcggcggcatgatcgtcgccggcctgctgggcctggcgatcgggctgatctgcctgaacctgcgcgccgactatctggcgatcgccaccatcggcatcgccgaaatcgtccgcctgttcctgaagaacgaggcctggctgaccaacggcgtgcgcggcattcccggcattccgcggcccttcttcgacagcggctatttcgaactcgcctatctggcgatggtgctggtgctggtggtgctggtctatctggcgatcgagcgcgcccgcaaatcgccgtggggccgcgtgctccgcgcgatccgcgagaacgaggacacggcagcggcggccggcaaggacgtggtcggcttccgcatccaggccttcgtcttcggtgcggcgatcatggggcttgccggcgggctctacgcccatttcatcggcttcatcagttccgaagccttcatgcccgaggtcggcaccttcctgatctgggtgatgctgatcgccggcggcagcggcaacaacaagggcgccatcctgggcgcgctggtgatctgggtcatctggtcgggcagcgagttcatcatcagccaggttctgccggccagcctgacgacccaggcaggtgcactgcgcctgctgctgatcggcgtgctgctgcaggtgatcctgctcacccggccggccggcctgttgtcggaagaacggctctaccgcacagggcgcaccgcccaggccgaccccaaggcccatcgccgcgaggtccgctgaccagaaccaacctgcgatcgcccccggttgcgtttgaaggtcagcgcatcgcggcgggaaagccgtggcggcgcgcaccggccagaatggcggctgcgggcagcagcagcaccagggccaccgggcccaggaggtccggcccccgaaggtcgagcagcaggccaccgatcagcccgcccccggcaatggcaaggttccagccggtgaccagcatggattgggcgatatcggcggcagggccggccgcgcgggcgagtgcggtctgaaacagggttgcagccccgccgaaggcaagaccccagaggccgatggctgccacgatcaccgcagcgtcactgccagccgccagcagaatggccgagagcacgaacccccagagactgagctgcattgcccggcggagatgccggtcgaccaccagcccggttgcccagatgccgaggatggcagccaggccgaagaccgccagcaccagatcgacccgcgcgcccagcccgacaagcgccagcagaggtgcgatgtatgtgtaaagcaggttgtgggcgaggacatagagcatcatcacggccagcacgcccgccacccccggcagggccagaacccgggacgccggcacccgccggccggccggctcgccggggaaatcggggaggcccagccggatccagaccatcagcagcgcggcccccaggctcatcagcgcaaaactcgcccgccagccgatgatgccccccaggaaagtgccggccggcacccccagcgacagggcgagtggtgtgccggccatggcgatggcgatcgcccggccgcgcagcgcatccggcgccatgcgtgcggcatagccggcaagcagcgcccagagcaccccggccgcgatcccggcggcaaagcgtgcgacgagcgtgaggatgaagctgccggagatggccgtgatgccgttggccagaacgaagcctgcgaccgaaaccaacagaagcggccgccggcgcaggccgcgggtcgccagggtgacgggcaccgcggccagcagcgatccggcggcatagaccgtgaccatctgcccggccagggcctcgggaatgtcgaaaacggcggcaatgcccggcagcagcccggccggcaatgcctcggtcagcacggtgatgaaactcgcaagcgcgagggcgagcaggccaccgagcggcagcccggctggggatgatgtcgtcatgtcggaccctgcggaaagatgtcggaggaggtgcggccgcccggccgtgtctggtaccggcttccaataggcatcagcaccaccccggaataaaccggccgatatgccggactttccggacagttctgtccgcaatcaggtcttcagatgatcatgcagcaggtcgacgaaggcccgaaccctgggcgaggcctgacggctggccggccagaccgcctgtatcaccccgtcatgcaccgccttgtccggcagcacctgaaccaggcggcccgccgccagatcggcggcgacggtgaaatccggcaggcaggtgatgccgcgcccggccaggaccagatgcagcagggcctccaccgtggttgcgaccacgctttcgggcagcggcacggtttcgggcaccggccagggctccagccggccggtctgggcgaagcggtgatgcaggcagagatgatccgccagatcatccggccctgcgggcatgccgttgcgggccagataatccggggccgccaccaggatcagacggaagcggccgatcaaccggctcttcagccgggaatccgccagcggtccggttcggatggcgacgtcgaaaccttcttcgaccagatcgaccagccggtctgagaagtcgagatgcagctcgatcccgggatgggcggcattgaacgcggccagcgccggcagcagcaggtgatgcaccagtggcagcgcgacgcgcagccggccacgcggggtggtcgcccgccgctcaagctccagttccaccgcctcgatctcgctcaggatccgccggcagcgctccaggaacagcagcccctcgtcggtgaggctgagactgcgggtggtgcggcggaacagggtgacacccagccgctcttccagccgggcgatgcccttgcccaccgccgaggcggaaatgccgagccggcgcgaggcggcaacgaagctgcccgcttccgcgacctgcaggaacagggtcaatctgccgagcccgtccattccccctccccccgctgtcgcggatccatggccggcatctgcccggtcagggccggctgacgggcggcaagggccgccgccagatgatccatcagcacccgcaccctgggcgtgtcgcgcagatcgggatgggtcaggatccagaggtcaaagcccagcccgttgagcgtgcgcaaccgcaccagccccggatcggcatcgcagagatagcaggcgaagagcccgagaccgatgccggccctgaccgcctggatcagcatgccggtatggtcggtgcgcagcacgacctggctgtcgggaatattggccgccacccagcgtgcctggggcagatccgcccgcccttgggcataggtcacccagggggcctcggcaagcgtggcctccggtggcagcggcaggcgatcgcgggccccatagatgccgtggaccagggtggcgatccgccggccgatcagactgtcgggcgggttgcggctgatccggatcgcgatatcggtctcgtgcctggcaaggctgacggtttcatgggaaatggcaatctcggtgcggatgccggggtgcagcccccggaacgccgccagcgcctcggccagccagggcgccagtgcgccgagtgtcgcgatccgcaccgtgccggtcagccgctgatcacggcccgacagccgccgttccagcgccaccagccgggtttcgacctccgacgcctcctcaagcagctcgcggccggcggcggtgagcgcatagccgcccggcccgcgatcgaacagcctgagcccgagccgcgcctcgaaccccgccatccgccgcagcaccgtcgaatggcgcacacccagggcccggccggcccccgtcaggctgccggcgcgggcgacggccagaaacagcctcagatcgtcccagtccatgcctgccgccatcctgcccgcctccggaaggtccagtctccatctgtgcatttacgcacagggcaggtcaagtttcagcggcttgcgcgatggtgtcgaagggcaaattctccagacgttccccgccgctccggagacccgtccgcccatgtccgccgccactgcccgcccgccgctcgtcaccgccctcatcgccggcctgctgctgatcgtgagcgcagccatccgcctgctgccagaggcggggatggcaccgggcggtctgtcgcccgcggcggcacctgcggcgaccctggtggtgatgaccctcggcctctgggcaaccgggctgctgccggaatcggtgaccgcactcggcttcttcaccatcgccatgctcaccgggctggcgccgccggaggtgatcttttcagggctcacctcatcggccttctggctgattttctcagggctggtgatcggggtggccgtccgccacagcgggctgggggcctggatcgccggccatctggcccgacgggtcgggaccagctaccggggcgcgctgctgggggcgctcgccttcggcctggtcatggccttcctgatgccttcggccatggggcggatcgtgctgatcctgccgatcctggcggcgctgggggaacatctggggcatcagccgggtgaccgccggcatgcgggcatgatgctggcgggggtgatcggcaccttcctgccgtcgttcaccatcctgcccgccaatgtgccgaacaacatcatggtcggcatcctggaagcggcaggtgcgcccgtgcccagcttctccacctatctgatgaccaatttcccggtgctggggctgctgaagacgctggtcctggccggcgtgctgctggccctctacggccgcggccggcagaagccggtgacgcgccccgaccgcccggcaccgatgacccgcgaccagcgccggctggccctggtgctgctggtggcgctgggcttctggatgaccgacgcgctgcaccacatctcgcccgcctgggtcagcatgacggtggcggtgatctgcctgatcccgcgcttcgccttcctgccgccccgggccctgcagacgctcaacatggagccgatcttctatgccggcggcgtcatcgggctcggtgcgctgatcgtgcatgcagggctcggcgactggctggccgccgtgctgctcgatgcagtggggctgcaaccgggagatgccgtcggcaacttcctgcgcaccggcgggctggcgacggtggtggcactggccaccaccctgcccggcgtgcccgccatcctgacaccgctcaccggcgacctcgccgccgccaccggcctttccacccccgccgtcctggcggcgcaggtgatgggcttctcgaccgtcatcctgccctatcaggccccgccgctgatgatggcgatcctgatcggcgggctgccgatccgcgatgtggcgaagctctgcctgctgaccgcgatcgtcaccattctggtgctctggccgttgcaggtgctgtggctgcgggtgatcggggtgatctgaccggcgccgtcagccgccggccagcgcatagaccctgagccggtgcccgtcggggtcgagccccatgaagctgtaaccgaagccctgcttcatcggcgccgcggcgatggtgacgccgcgggcctgccagtcggcgaagaccgcatccacggcggcatcatcggccatgcggatgccgagttccgaggcacccggcgccgccgacggtgccggcacgaccacggattgtgcccagaggccgagcatcatgccgccctccagggcgaacagggcgaaagccggggacacatccaccgggcgggtgtcgaagagatcggcataaaaggtggcactggccgccgggtcggcgacatagagcagcgcatagctcggatgggtcatcattcccgctcccgttcgggcagcccccgatgagccgccctgacgggatcatgcgcccgggctgctgacagggtctgtcaacagcccgggaaacaccgtcggacatgtcatcctttcacgcagaccacctgccgcagggtgtggaccacctcgaccagatcggcctgggcagccatcacggcgtcgatgtccttgtaggctttaggcgtttcatcgagcacgcccgcatccttgcggcattcgaccccggcggtgtcgcgcagatgatcgtcgagggtgaagcggcgatgggcttcggtgcgcgagaccacccgcccggcgccgtgggagcaggagcagaagctttcggggttgcccctgccgcgcacgatgaaggacttcgcccccatcgaccccgggatgatcccgaggagaccctcggtcgcacgcaccgcccccttgcgggtgacccagacctcgcggccgtaatgccactcgcgcgccacataattatggtggcagttcaccgcctccagcgctgcatcgaaaggccgcgtgaccaccttccggagggcggcgaccgcatggtccatcatcacccggcgattggtcagggcgaaatgctgcgcccattccaacgccatcacataatcgtcgaaatgcgccgtgccctcgggcagataggccagatcggcatcaggcagatccaggtgatagcggcgcatatcctctttggcgaggtcgatgaaccgggtgccgatcatattgccgatcccgcgcgagccggaatggagcatcacccagacccgcccggcctcgtccaggcagacttccaggaaatgattgccggtgccgagcgtccccagatggacgatggcattggccttgaccagggccggatggcgggctatcagcgcccgatagccggcatcgagcccggcccaggcttccgtcaccgccgggggcagatcgtcgccccacgcgccgacatcccgcttcttccgcccgaccgtgcggccatggggcacggcggcttcgagcgccgagcggatgcccgccaggctgtcgggcagatcatctgcggtgagcgaggtgcgcaccgccatcatgccgcagccgatatcgacgccgaccgccgccgggatgatcgcgcccacggtcgggatcaccgagccgatggtggcgcccttgcccagatggacgtcgggcatcaccgccagccatttgtggatgaagggcatcaaggcggtgttgagcagctgccccatcgcacgctcgtcgaccggcacgccgcgggtccacatcttgaccggtgcggccggccggtcgcgggcaggttcgtagcgatgcgccagaaggtcgaaagtcatcgggggtccccaactgcaaaaaggtaagtctggcgctctttgcgaggtgcgtgccagaccggccctgcgcgagggaaatccacccaagtccttgctttgtaaaggcctgatggccagaggtcgcaccggctgggcagaggcatcccgaccggatatgatccggtcatctcggaagttatacgtcaggataagggcatgtcgaagcgccgggtcgcgatcgggttcgtgggcaccacgctggatgtggcggcgggcccgcatcgctggaaggcctggcggccgacaatcgccctgatccagcagccggagatcggcatcgatcggctgcatcttctgcacggggccgctgcccgcaaactggtggcgcggcttgtggacgatatccacctgatcgcgccccgggtagaggtgcaccccgaagaagtgacgatccgcgatgcctgggatttcgaagaggtctacggcctgctgcatgatttcgcccgcagcttccccttcgataccgaggccgaggattatctgatccacatgaccaccgggacccatgtgatgcagatctgctggtttctgctggtggaggcacgctacatcccggcacggctgatccaggtgtcgccgccgccggccagggaacggccgggcggcttcggcagccataccatcatcgatatcgatctggcgcgttacgaccgcatcgccggccgcttcgggcaggaacagcgcgagcgtacatcgttcctgaaagccgggatcgatacccgcaatcccggcttcaaccggctgatcgagcgcatcgaacgggtggccctgcattcgaccgcgccgatcctgctgaccggcccgaccggcgccggcaagaccgccctcgcccgccggatcttcgagctgaagaaacagcgccgccaggtcgacggcgccttcgtcgaggtcaactgcgccaccctgcgcggcgatggcgccatgtcggccctgttcggccatgtccgcggcgccttcacgggggcggtggccgaacgggccgggctgttgcgcgcggccgatggcgggctgctgtttctggacgagatcggcgaactggggctggacgaacaggcgatgatcctgcgcgcgatcgaggagggccgctttctgccggtgggcgccgatcgcgaggccgccagccggttccagctgatcgccggcaccaatcgcgacctcggcaccgccgtggcggacggccggttccgcgaggatctgcttgcccgcatcgacctctggagcttcgacctgccggggcttgcccgccggcccgaagacatcgaccccaatctcgacgaggaattacgccgtcatggtgtccgggaaggccgccaggtctcgttcagccgcgaggcccggcagcgcttcctggccttcgccaccggcccaggcgggctgtggccggggaatttccgcgacctcggcgccgcagtcacccggatggcaaccctcgcccccggcgggcggatcaccgaagaggtggtggcggaagagatcgagcggctggaatgggcctggcagcggagggccgccccggcccgggaggacccgctgccgggtctgctgagcgaggcacggctggcggagatcgacccgttcgaccgggtccagctggccgaggtcgtgcgcgtctgccgcagcacacccagcctgagcgccgccgggcgggccctgttcgcagcctcgcgagcccggaaagccgcacccaacgatgccgaccggctgcggaaatatctggcgcgtttcggcctggactggtcgagcgtgcaggtgttgacggagtgaccgtcaggccgcgtcggtcgcgcgggcgaggccgagcaggctggcgatttcgcagcgcgggcggacaagatcggccagggtgtagcggtccatatgggcatagaaggcttcggccgcttcggccagcgcaccgcgcagcacgcaggcgggcaggatgcggcaattgccgtgggtgtcgaagcattcgagcagggcgctgtcgcgctcggtttcgcgcaggaccgcgccgatgcggatgtcttcgggcgcctgccccaggcgcagcccgccgcccttgccacgcacggtttccagatagccgagccggcccagctggtggaccaccttcatcagatggttgcgcgagatgtcgtaggcttcggcgatctggctgatggtgaccagccggtcgggggccaccgccacgaagatcaggctgcgcagggcatagtcggaaaaggtggtcaggcgcatcggcgtgctccggtggcggcggtgccggcccctcgggagccgcgttctaagatatatcccgaatgcgtctatatgccaggggcatccggtccgggacgcctcccccggacaataagacgcggcggccggttgcccggccgccgcgctggtcgtcagttctgtaccccaaaggatcggtcagagcttgggctcgacgatctcgcgggtctcgacggtgccgttcttgaactcgtagatcgcgaaggtgccggagacatcgccggcggcatcgaaatcgagcgagcccgaagcaccgacatagtcgatgtccttgccttccttgatcagcttcaccgccttttcccactcgcccggcaggatcttctcgccgggggcgttggcgacgtcgcggagcgcgtcgcggatcttggtgccgtcggtggagccggccttctccatggccagcgccaggacatagacggcgtcataggtggtgtcgatatagggcttgggcggcagctgcttgaacttcgcctcgtaggcggtgcggaacttcgccgccgccgggctgtcggccacggcttccggcgcgatgccgaccgtgtccttcaggtattcctcgccgatcgcctgcgacatttcgggcgccttcaggccgtcggagaagacgaacttggtgaacagcccctcttccagcgcctgccgcaccacggtgctgccgttctcggggtaggcgatcaggaccagcgcctcggcaccgtccttggcggcgttggtcagttcgccgcgataggacgcgctgcccggctcgaaggcgagcgaggccgcaaccttgccgccacccttctcgaaggtcttggcgaattcttccgccagaccctggccgtagtcgttgttgatgtacatcaccgacacggtcttgtagccctcgttcgccgcgagctggcccatcaccgtgccctgcagcgcatccgacggcaccgagcggaacaggaagtccttgtcgtcgagcgaggtgatcaccggcgaggtcgaagccggcgaaatctgcggcaccatgcgcgccgccgagaccgtggtggcgaccgggatggtcacgcccgacgagagcgcgccgaccatcgcgttgacacccgccaccgagaccagacgctgcgccgcgtccacgcccgcctgggcgttggtctgggtgtcggccacttccagggcgagcttgccgcccagcacgccgccctgcgcgttgatctcttccatcgcaagctcggagccggtcaccgaggccacgccataggcctgaaggtcgccggtcagcggcatcagagcaccgatcttcgctccggcggcccaggccggcgccgcagcgacgatcatcgaggcgacaacggccgcagtggcggtccggatcggattgagcttcatcgcttccccatctttttctggttgcgatccaacatcatgcgtcgacgacccgggtgccgcggcgtccggcgggggccttgggcggtcaccttcggcaaccggccggcccggatccgaccaccgcgagccgtcgttccggagcagagagaccctgcgccatctctcccgcgcaggccacctgccccggcctccccgggctcgggctggggccattatgcacggctgggggcggaaccagaagcggggaaactcgccttacgcctgataggaaagccatgcagatcgcgcacgggtctggtgccatgcagaagctgcattgttgcagtgcgaaatggacccctcccgaaaccgatcgatcaggcgtatctctagctcatcgaaacgacacgatgcgccgccgcagctcaggcgccccgaccgagccccccaagcacgcagccctgaaagaccttcaggatgcgaccggtcgagaggcccggcagcgaagacggcgcagcccctaggagacctgtcatgaccgccttcatccctggcgtcatctcgctgaagaacgttgttgcccggatgatccggtggcgccttgagcgtcggacctatgccgagctgaagtccctcgacgaccgcatgctggccgatatcggcatctcgcgcggcgagatccgctcggtcgcgacccatggtcgccagggtcacgaggttgccggctacggcgtgtgatccagcgagcccggctgtggatatagccggagatcgcgcctgaaacaagcttcgcatcgggagacgtcctcccccggatcccgatgcgataactgaagcgtttcccccgcttcagcctgcccgggccgctgccgccctccctcggcaaccggcccgaccccagcccggcgtctgctgcgcctccgcctgccctccctcaggcccgagtgctgcgcgacgccgacgggaccggtcgttccccacttgcgaccagccccgcgatgcatcaacgacggtccggccgccctccctcggccccaccgtccgcccctctccccaaggggccgcatcgccgggccgcaagacggaccggtcaccgcatcacggccccgacgcttcccccgtcggggccgttttttttgtcccgctctctctcctctcatcgctttccgcatccctgctgatggaacccgatcgccgacgccgaggttggcatgtcacgggatccgcgtcgttcctgcggccggcccgttgagtgcagttcagagatggagagggacgtgtcgcgcccgacggacatctcgcgccgggattttctgcgcgccgccgctgctgcgggagtgaccgcatcggtcatgccgctgggccaggccctgggggcgatgatccccgaaggcagcacccgccctcccgactggctggacgagtcagggcgcatccgcttccgccatgacggcatccgcaaggtgaccggcgacaaggtgttcgcggtcgacatccgcgcccgcgacatgccgggctggcccgaagcccagtctcatggcttcctgctcagggcgacccgggccgaccgggtgttcgagggcgtcgacctgtcgatgctgccggaagagctgatgcccgaccggctggtgaccgacgccgagcttgcagccgacggcgtggccatgcccgagcccgatttctatggcgacctgctgctcaagaccggtgagataccgcctctgctgggccagccggtggcactgctgatctatcacgactatccgcgcttccgccgggcgaagcagctgctgcaattcaacgaggatgccatccgctatggccgggagacgggggcccaggcccgcccgccctatggccgcgcacgcttcgtgcgcatcggcggggccacccccgtcgcgcccgatatctattcgccaatgaccggcaccgtgctgcgaccgcccgcagacagcaacgactggccggcggccgatgcagagggggatgcggcggcgcgtgccatgcatgccgcagaagagatcgcccgcagcctggagagcgccgacgacgatctcgcggtcttccggcgggaatatcattcgccctatgtcgacccggcggcgctggaaccggacaacggcaatgcctggtacgacccggccgccgggcgcctgcatctggtgaccggcacccagtcgccctacaccaacgccacccatgtgatcgccatggtccgggccagccggttccggctggacgagctgcgcttcaatgccggctacactgtcggctacggccagaaggaacatcattccctgccctattacgcggccatggccgcgctctacgccgaaggccggccggtgcggctggcgctgaaccggtgggagcatttccagaccgcgatcaagcgccaccccttccggatcgatgccgcgatcgcggtcgaccgccggacggggcagttccggacgctgcgcatggatctgctgggcgatggtggcgggcggatgaatttcagcccctcggtgggcgaggtcgcggcaagtgcggcgcagtcgatctactatttcccccaaagcgacctgtcggtgcggatggaggcgtcgcgcgccccgaccgccgggtcgatgcgcggctatggcacgctgcaatcgatgagtgccaccgaaatgctggtcgacgagattgcagacgagctgcggatcgatgccatcgaactgcgccggcgcaacctgctcacggcgggcatgaagaacacccagggcgccgtgccggccgggttgctcagggcaggcgaactgctggaggtggccgcccgccacccgctctggaccgaacggcacgagcgcaagcggctgcacgaccaggaccatcccggtcatcactacggggtgggcttcgccgcggtgcagaaggattacggcaccggcgccgaggcggcgatcgcccgggtggcgctggacgcagacggccatatccaccttcgccacgtctgcaacgagatcggcaacgggtcgacctcgtcgcagatgctggtggtggcggactggctgggccggccggcccatgatgccgaattcgcggtaaccgactggccggaactgccgctgacctcgaatgacgagccctataccatgtcgcaggcggcgcaggaccaggcggcccgtgatccccattgggtgccgcggatcacctcgccgcgcagcgcctccaactcggcctattacctgtcgcatgcaacgcgggaggcggcgcggatcctgttcgaacgcgggctctggccggcggcgctgtcgatctggcgcgagggcatcggcggcggccaggcggccccgctcgcgatccggcgcgaggaggcggtgtggcgcgacggattgctggtcgcggcctcgctggagccgctgccgctggcccggctggcggcccgggcccatcagatggggctggtgaccggcgtcgtggtccataccttcaaccgctggtcctggaccgaggcggagttcgagctggaggacggcacccaccgctggccgatcgatgcgctggcgctgcgccggggcgatggcggctatgacttccagccccgccggcgggtcttctacccgcccgtccagcgcaacaatgccgccgtggtctattacgcgccggtcgcaaccctggtcgagctgtcggtaaacggcggctcgggcgagatccggttgctgtcgcaccactcgtggatggaatgcggcaacatgatcgtgcccgagctggtctcgggccagctgcagggcggcatcgccatgggcatcggccatgccctgttcgaggaattgccgctgtacgaggacgggccgggcaacggcacctggaacttcaaccgctaccggttgccgcgcgcatcggatgtcgcggtctggtcgcagaccggccaggtgctgccgccgctttcacccaccgacccgcccaagggcatcgccgaggtgaccatgatcccgatcgtggcggcgatcgccaacggcgtcgcccatgcgatcggccaccgcttccacgacctgccgatccgccccgaaaagatcagggaggtgctgctgtgatccccgccaccagatcggtgcggctgaccgtcaacggccgggataccggcccggtcgaggtgcccgaagacctgatgctgcttgaattcctgcaggaatatctgaacctgaccggcacacgctatggctgcggccagggggtctgccgtgcctgtaccgtgatcctggaccgccccgacggccgctcgcgggcagtgccgagctgtgtgaccggcgtcgcccatctggatggggcgcgggtccgcacggtcgaaggccatgccggccggaacgaggatggcagcctggcgctgtccgccatccagcaggcctatctgacccatttctccttccagtgcagctattgcaccccgggcttcgtcaacggcgcgaccgtgctgatcgaacgcctggcccgcaaaccggtgccgcgccgggatgtggagcgcgtggtgctggaaggcatggaccggcatatctgccgctgcaccggttatgtccgctatctggccgcggtgcgcgacgtcatcctgtcaacgccggggctgaccaccgaccggccggcgcagaagcgggatgacggatcatgaggcggcggctgattctgggggcgcttgccctggtcgttgtcgtggtcgtcgcggtggtggcggtgccgctgctgaccggcgccgggccgatcccgcctgcgacggtggacccggcccggctggatgcgggccagcgcgcccggctggtggaaaggggccgctacatcgcccgtgccgccgactgcgccgcctgccatgtggccgaggatggccgcgcctatgccggcgggctgccgatggaaaccccggtcggcacgatctacggcaccaacatcacgccctcgcgcgatcacggcatcggcgactggagcgcggacgatctctatcgggcgctggtctatggcatcctgcccgatggcggccgtctgtatccggccatgccctatacttcctatcacgcaatgacccgggcggatgtggatgcgctcgcggcctatctcgccagcctgccggcggtggagaagccgaaccggccgccggatctggcctttccgttcaacatccgaccggcagtcgccttctggaacctgatcttccggcccgagccgggtgatctgccgccgcccgcgggcaccgccgcgccggccggcgatcccgcccgcggccgctatctggtggaggtgctgggccattgcggcgaatgccataccccccgcaaccttgcctatgcgatggaggacgaccggcatcttcagggcgaggtgatcgaaggcgcgctcgcccccgacatcaccccggccggcctctcggcccgcggctggacggccagggacctgacccgcttccttgccaccggcctctcgccccagggcacgatgaccttccgcatgtatccggtgctccaccattccacccgctatctgacggcggaggatgtgggggcgatcgccgcctatctgaccgacggggccccgcccccgacacggcccgaaccggtcacgaccggcaacacgcggaacgccggccacgacatttatctgggcttctgcgccggctgccacggggccgatggcgaaggccaccccgccgcctcgccgccgctggccaccaacaccaccgccatgctgcaggatccgcgcaatctggtgaaggtgatccgcgacggcattccggcccgcccgctcgccggcaccggccggatgcaggaaatgccggccttcggcgacctgctcgacgacggcgagatggcggcgctggtcaactatctgcgccaccgctggggcggacagcccggcgacgtcaccgcagagcgggtgtcggaggtggggccgcgctgagcggttcccatattcggtccgcgtcaggcatagagcccttcgatgacatccgtgtacttcttgtacacattgctgcgccggatcttcatggtcgccgtcacttcgtcgtcgtcatggtccagttccttggtcagcagatggaagcgacggatctgcgacaccggcgcgaggccggcattggcgcgggcgatttcggcctcgatcagggcccggatcttggggttttcggccagcgagcggaaggtggtataggcgatgccctgctcttccgcccaacgcgcgacggtgtcgtaatcgatctggatcagggcggcgacgtatttgcgccggtcgccgatcaccacgcattccttgacataggggctggatttggcggcgttctcgatctcggtcggcgacagattcttgccgccggcggtgatcatgatgtccttgatccggtcgacgatgcggatatggccgtcgacctcttccccgacatcgccggtgtgcagccagccgtcgcggatggtgtcgcgggtcgcggcctcgttcttgtaatagccggcgaagaccgagccgccccgcaccaggatttcgccggtggcgggatcgagcttcacctccaccccctcgacggcggtgccgaccatgcccggccgggcatcctcgggcgcctggccgacggccacgcccgaggtctcggtctggccataggcctcgaccagcggcacgccgatggtgcggaagaagcgcaggatttcaggcgaaatgggcgcggcgccggtgattgccacatgtgcccggcgcaggccgatgaagttctgcagtgcccggaacaccagcagataccagagcccgaagcgcagccgctcgaccatcgtccagtcacggcgcggcttccaggcaagcggcgtgcagtcgcggaccgcccggtcgaacagcgccttccgccagccgccggtctcggccatcttgatgtggatcgccgcgtgcagcttttcccagatccgcggtacgcccatgaagaagctgggcgccacctcgcgcagatccgactgcaccgtgcgcaggctttcgccgaacgagatccggctgcccagatagagcggtgcgaaattggtcatcgcctgttcggcgacatggcagagcggcagatagctgaggctggaggcctcgccatccagatgcagccgcgcgaccagcccgggcacgacatgggtgatgttgcgataggtgatcacggcgcccttgggctttccggtcgagcccgaggtgtagatcatgagcgcggtatcatcgagcgtctgggcatcgagcagcgcatcggcgcggccgggatcggcggcatggtgttcggcgcccagccgttccacctcgtcgaaggggatcaggtcgggctcgtcatagccgcgcaggccgcgcatgtcgacgaccacgatccggcgcagccgcggcagctccgcccgcctctccagcaccttgtcggcctgttcctgatcttcgaccaccaccacgtcgacatcggcatgggcgagcacataggccacctcccccgccgggctggtcggatagacgccgacggtgaccgcaccgatgatgccggtgcccagctgggcgatcacccattcggcgcggttttcggacagcacgccgacatggccgccggcgcccacccccagcacctccagccccaggccgaaggcgcgggcgcgctcgaaatagccggcccaggtgatcggctgccagatgccgtaatccttctggcggatcgcgagccggtcgccctgcctgcgggcatgctcgcgcagcatctggggcatggtcagggtcggaatcgccatggtcatgacagccaccgcttacgccgcttgtaatgcttgatgtctcggaaggaccggccgccgccatcctcgccgccatggcccagatagaactcctgcacgtcctgattggcggcaagctgggccggcgtgccatcgatcaccacccggccgctttccatgatgtaggcataatcggcgatcgcgagcgcgatcgcggcattctgttccaccagcagcaccgcggccccgcgctcgcggttgatgcgcagcacgatcgagaagatttcttccaccaccatgggggcgaggcccagcgacggctcgtcgagcatgatcagctgcggctccgccaccagcgcccggccgatggccagcatctgctgctccccgcccgacagatagccggccagccccttgcggcgctctttcagccgcgggaaatagccgtagaccatggccagcgcatcgtcggtggacccggcgctgccggcgctgcgggcataggtcgcggcgatcaggttctcttcgaccgtcagatcctcgaagacccggcggccttccatcacgtggaacagcccgtcatggaccagccggtcgggttcccgcccccaggcctcgcggccgcggaagcggacatggccggcggtcagcccgccattctccagccggatcaggccggacacggtcttgagcgtggtcgacttgccggcgccattggcgcccagcagggccacgatcgcgccgggggcgacgcggatcgacagcccgcgcagcacctgcaccgtgtgattgtagacgacctctatgttctcgatatcgagcagaggatcgggagaggctgacgtcatcggcagggccccggtggctgtggccggcccgggcacaggggcccgggccggccttgggtcggatgaggtcaggtgagcgcgatccagtcggaggccggcacgtagcgcttttccgagaacttcacctgatagatgcggcccaccggcaccgaatgggtcttcatcgaaatcggcaggccgatgatgccgccggtgtcccagttctcgatgctctccagtgccgccttcatgtttttggcggtcatctcctggccgccctccagtacccgccgggcgatttcggcaaagagcatgccggtgaaccagctggcgacataggggacggggcgataggtcacgtccggcgcatgctgcttcgtccaggcccgcatggcctcgaaattggcgccgctggcatcactgtcgtaatagttgtagggcatcacccccatgaagccgtctgacggctcgcccacctgatcgatcagcagcttgtccatggtgtaataggtgcccatgaacttcgtcttcaggcccatctgcttcatctgaacgatgaattcattgattggcgacagcacatagccgtggaagatcacatagtcggggcgcgagcggcgcagcttcagcacctcggccgagacgtcgacgctgccgggtttggtcacgatctcgtcgaccagttcgatgcccagcgccttggcgcgcgccttggccgaggcgatcgggtcgcggccgaattcggtgtcgctgtagaccagcgccagcttcggtgccgagccgcccgaggcctcgttcttgatgtattgcagcaggatgccgacctgctcggcatagctggggccggcgatgaagtgataggggtagcggccgggatcggccagttccgaggcgaagctcgcccccgacatcaccgtcgtgcccagctggaccagttccgaggcgatcgccttttcgaagccggtgctgtcgccgaaatagaagggcggcttgtgggcggcggtgatcttcttgaaggccgccaccgacacgtcgaccttgtagccggtgtcttccatcacatagcgcagctggcgcccggcgacgccgccattggcgttcttccattcgacgaaatcgttcagcccctgatggccggcgatgccggcaaaggcgaagacgccggtcatcggcagcgagccgccgatcacgatgtcgtcggcggcaagcgccatccgcgggtcgagcccggtcttgagcgccaggccgagagccgcggcaccgccgccatatttcaggagatcgcggcgcgaaacgccacgcatgatgctggacatgggtgtctcctccctgaaaggacgcctgccgccggttcgtgccggcggtcgttgacgatcatgcaggcccgcggcacccctcaggtgcggaagggccagagatggaagaaccgccggagcctgcgccacatctcggcgaggccatggggttcgaagatcaggaacaggacgatcagcagaccgaagatcacttcgcgcatcggcgaaagcacgaccggggcctgcgggtagaagggcgtgaccatggtggtgacgaagcgcagcgcctcgggcaccagggtcatgaagatcgcccccaggatgccgcccaggatcgagcccatcccgccgacgatgatcgcggccaggaagaagatcgacatggtgagcgggaagctttcgggcgtcaccacccggaagaaataggcgaagagcccgccggcgaccccggcatagaaggagctgagcgcaaaggcgtagagcttccagcgcaacaggtcgatgcccagaacctcggccgagatgtcgcggtcgcggatggcgatgaaggcacggccgacccgggtgcggaacaggttgcgcgcgcccatgcaggcgatgaccgccacccccatgatcagccagtacatcgaccggtcgtcgcccagcaccaggccgaagaggtcggccggcggcacctgcagcccgccgatgccgccggtgaccgggtcccaatgggcgaagacgaaatgggcgatgaccgaggcggcgagcgtcgcgatcgcgagatagagccctttgaccctgagcgagggcaggccgaccagcacgccgaaggcggcggaggcaagccccgccagcggcagggtcaggatgaagggcaccccccagcgactggcgagcaccgcgaccgtatagccgccgatccccatgaaggccgcctggccgagcgagatctggccggtgaaaccggtcaggatgttgagcccggtggcgctgatcacgttgatcgcgaccagacaggccagatagatggtgtagtcgttgccgatcagggggaagaccaggatggcgacgatcagggccgcgaaccacgcccggcgcacgggcgtgtcgaagatcatctcgtcggcgatatagctggtcttggcgtcaccgatacgcatcgcgatccggtctccggtgcggtggtggcgaagggaacgggggcagacacccggtcagagacgctcgatctcgcgggtgccgaacaggccgtaggggcggacgatcaggatcgccgccagcagagagaaggtggcgagctggcggtattcaccgcccagataggtgccggcgatggtttcgatccagcccacgaacagcccgccgatcagcgcgcccataatgctgtcgagcccgcccaggatcacgatcaccaggatcgacagcccgaccacgcccatctgcgggctgagcccgccgctggccgcgaccaggatgcccgagatcgcggccgcaaaggccccggccatccaggctgccgagaacaccttgggcacggcgatgcccatcgaataggccgccgcctgatcggaggccgtggcgcggagtgccacaccgccgcgggagaagcggaaatagagcagatagaccacgatcacgcaggccgcgatcacgaaggcccagcccgatttcggcgccacgaacatctcaccgatcatgatcggctctcgcggcaggaaatcgggcagcagctgcggatcggcggtccagagcatttcggcgaggccgatcagcacgctggcgatgcccaccgtcaccatcaccaccgagatcgggttctcgcccagcatcggccggatcgcgacccgttcgatcacgccgcccagaagcgacccgccgatcaccgccagcggcagcgacacataccagggccagtccaggatgccggcaaaggtgaggaacagataggccgagaacatcatcatctcgccgacggcgaaattgatgacccgcgtcgccttgtagatgatcacgaaaccaagggcgatcagggcatagagcccgccggtcgccagccctgcaaggctgacttcgccgaagaacagccaatccaacggccgcctccttccacatacaggatgccaggcaagggggtgtctggtcggacgggacccgtcggaggaccgggacgaccggcggtcaggccgccgcctggcccgcctccagccgtgcacgcatctgcccgacatcgcccgcccccagataggcgcggatgacctcgggatccttctggacgtcggccggccggccggcggcgatgcgcctgccgaaattcagcaccgcgacatgatcggaaatgtccatcaccaggcccatatcgtgttcgaccatgagcacggtgacgccccattcctctttcacgtccaggatgaagcgggccatatcctcgcgttcctcgcggttcatgcccgccaccggctcgtccagcatcagcacggtcggccgcatggcgagcgcgcgcgccagctccacccgcttctgcaggccatagggcaaggcaccgaccggcaggccgcggatatggtcgatttccaggaaatcgatgatccgctcttccacctcctgccgcagccgcgcttcttccgcccgcgcccggccgcgatagatcagcgcgtcgaccagcccggtcttcagatggacatgcgcgccgagcttgatgttgtcgagcacggtcatgccgcggaacagggcgatgttctggaaggtgcgggccagccccagcgcggcacgggccggcggcttcaggcgactgacgtcgcggccgcgaaagcgcacggtaccggtgttcggcttgtagaaacccgagatggcgttgaacagcgaggtcttgcccgcgccgttggggccgatcacggtggtgatcgaaccctcctcgacggtgagcgacacatcggtcagggcagccacgccgccaaacttcagaccgacaccctcaacttcgagtatggccgtcatgtcgcgcccgcccgacggcagacgcgcggatgcacctctcccgtctccccggcacgggcgcatccgtgccgtcgatggtgaccgttcaccggtaatgtctccctccctcgcggggcggtctttattattttagaaccactcccgtcccttcaggctaggaaactgtccggtaggtgtcaatcgacattacccacgggtaagaagatttccacgccgtaaaagcgacagcccgcgtccccggaggtccaggggcgcgggctggccgcaaacggatagattgcaccggtggaacccggccggatcggcgccggtcagacggcgacgaagcgccagatgccgtcctcgccggtctcgcggcggatggcgttgcggtggaccagattgttgatatgggccagcgcctcgccggtggcgaagaccagctgttgggcatccagcttgcggttgccgaacagcagcgggaacgtgtcgcgcacggtgcagggcccggcgcggcaggcggtcaggatcgcgtccagccggtcgtggtgatgggcggccagcgcctcgacccggtgatgcaggccataaaacggcgcgtcatgggccggcagcaccagcgtgtcttcgggcagttcaaggaattgcggcatgtcggccaggaacatcgccagcgggtcgccgtcgggttcggtcggccagaccgcgacattggggctgatccggggcaggacctgatcgcccgaaatcagcaccttgcgcttttcggaatagagcgagacatgctcgacggcatggccgcggccgatcagcacctgccattcgtcgccgccgaaggcgaccttcgcctcgcggctcatgcgcaggaagctttgcggcagttccgatacgcccttgcgatagccgctggtgcggccgtggatgccctcgatctcgtcggtggtcagccccgccttgcggtaataggagagcctggcgtcatgggcgcccgaggcgacctcgaaccacaccgcccgcgccatcagccattcacccagcgaggcatggaaacgcgcgccctcccagcggcgcaccatccagccggccagacccatatggtcgggatggtagtgggtgacgaccacgtcgaccaccggccggccgccgagcgtcgcctcgaacacctgctcccacagatcggtggtcatgcgggtgttgataccggtatcgacgacggtccagccctcgggcccgtcgaccagccagagattgatgtggttgagcgcgaagggcagcggcatccggacccagaagacgcccggcgcgacctccaggctctgccccggctccgggcgggtggtcaggggatagacgaccccggcggcacgatccatgtcttggcctttccttgcatcacctccccctcgtcagacagatccgtcttctcagatcccggcccccgcctctgcgggcgttcggaccgtcgtcgtctgcggcacaggctttcccgcggcttctgggcggccgccttggaaaaccgcgccgcagccggggcctggcggtcgcccgccacggccccggtgcatgcgcatgttcctggcgatcaggccgcgaactgctcggggctgagcgccatgatcgaggccgagccggccttgacggtgcgggcaagcccggccgcgagcggcaggacctgctcggcatagaagcgggcggtgatcagcttcgcttccaggaaggccgcatcgtcggcaccttccgaaagaccgcggatcgcggccgcggccgagatcgccatcatccagccgccggccaccgtgcccatcagccgggcataggcggtggcaccagacagcacggactgggcatcgctgccggcccgggcgatcagccagtcggtggcatcgtcggcggcagccaccgcctcggccagcgcggcggcgatggtcgcggcatcgtcgccctccaccgccttcagcgcgtcagcggcagcgcccatctcggcgaccagcgccttgatcgactggccattgtccatcgacagcttgcggccgaccagatccatggcctgaataccattggtgccctcgtagatcaggcagatgcgggcgtcgcgcagatgctgggcggcgccggtctcttccacatagcccatgccgccatggatctggacaccggtcgaggccagctcgaagccgagatccgtcgaccagcccttcacgatcgggatcatcacctccacccggcgctgggcctggcggcgggcatccgcatcctcggtatggcgggcgcggtcgatcatcgcggcggtgtaaaggccgagcgcacgggcggcttcggtctgcgacttcatcagcatcagattgcggcgcacatccggatgcatgatcagcggtgccgcaccctcggcgccggcagcgcggccctggcggcgctcctgcgcataggcgagcgcctgctgataggcgcgttccgcgatcgcatagccctgaatgccgacattcagccgggcattgttcatcatggtgaacatgtactgcaggccgcgattctcttcgccgatcagatagccggtggcaccgccaccgtcgccgaactgcatcaccgcggtcgggctgccatggatgccgagcttgtgctccaggcttgcgcagcgcaggtcgttgcgctggcccagcgtgccatcggcattgaccaggaatttgggcacgatgaacagcgagatgcccttcacccccgccggcgcatccggggtgcgcgccagcaccagatgaacgatgttctcggtcaggtcgtgctcgccataggtgatgaagatcttggtgccggtgatggcataggtgccgtcatcctgcttcaccgccttggtgcgcagcagcgccagatcggaacccgcctgcggctcggtcaggcacatggtgccggtccactcgcccgagaccagcttttccagataggtctgcttctgcgcgtcggagccgtgggcggtcagcgcctcgaccgcaccgatggtgagcagcgggcagaggccccaggccatgttggccgaattccacatctcggcgcaggccgaggcgaccgtaatcggcagaccctggccgccgaattccggctcgaacgggatcgagttccagccgccgtcgacgaactggcgataggcctcgcgccagccttccggcgtgcggaccacgccgttttcgaccttggaacccgtctgatcgccggtgcggttcagcggcgcgatcacgccgccggccagcttgccggcttcttcgaggatggcgtccacggtgtcgggggtcgccgcatcgcagcccggaagctgcgacaggccttcgatgtcgacgatctcgcgcattacgaagcgcatgtcgcggatgggtgccgtgtaaccgaacatggatgtcctcgaagtctcggggccttggagaaggctcggggccgtgggagagggatgcagatgactggaaagatcgaccggccagcgtgaaaagcaaacgctcgcttggcaatattccaccaccaggggtcgcccgaaggacccctctggtacaagccggcccctcgatgcgaccgccacccgccgcaaggcaggctgctttcgcccgacgttatagcatctgcggcagacgcatgcaggggataaacgtcacgaggcccggcaccgccgcctgcacaggcgacgggccgggccccggaaggcgcaaggcggggctgtgatcagtcggccgcctgacggcgggcagccgacggcgcgggcgtgacggccgcggccgagaaggcctcggtcgccagcgcggtcagacgggtcgcctcgtccatatagtcgcgcacggccttttgcgcgaagccgttcgccatctcgatgaagtccaccggcgtgcggcaggcgccgagttgcttctggctggcgaagtcgtcattcagccgccccatcacgaagcggccgtattcctgtgcgatccgcccggccgcatctacgaccgcgcggttgatctggaaccaggtctccacggcctcgcggccgccggtcatcatggtgtcgaaagacaccggcggcagaagcgccgtctcgggtgctgcggatgtcgaggggctggcggtcatggctgtttcctccacctcaggggggcggtgcgacagcaggggtcgcattcatctttcgtttaccctgtcacaaaaatcaataccttgatctgcatcaacttccggtcggtttcatgtgccgataaacgccgaatcgagccccagctccgtcatccgggtgccggccaccgatatcgaggtcgtcaccatctgcgggtgatcctgatcgatccgctggcggggtgaggcgcgtcaattcgcgcccgaggcccgccggatgaaatcgccgacggcagtgccgcgcagcatggccaggcgataggcgaacatcgccccgcgcttgcggagatccgtggtcgccatcttgtcgcgcagctgcttcagccgttcggtgtcgagcatctcgcaggcagccggtgaccgcagaatgccctcgaccgtgctgtccaacagctccggcttggccgtcagggcttcatgccagtccggtgcctgcagaccacggcgacgctccgccagcacctcgcgtggcagacggtcggtcatggcgcggcgcgcgagcgcacgcccgccgccattctcgacaaagatctcgtccggcacccgcatcgcaaactcgatcagacggatatccgaggtcggatcccggctgtccagcccccagccggccagcgtgcccttgtgatagtttccgccgtcaatgcgtcgcaacaccctgagacgcaattcgatgctgtcgaggcttgggcgataggagaggtcgaaaccggccttcttcgccgcttcgaaggcccgggcccgcttgtccgggtgcagcagggaaatgttggcaaggtcggtatcccgaccggccagcttcataagcccggtccatacctttgccggcaaggccgggccgatggactgcgccagcatgccccgccaccgccactgcccgccggcgcggacatggccgcgcgcctctttgaaccagcgcaggagccgcccggacagaaagagctggggatagaaggtatagccgtcatagctgaggctcatattccccatctgccccgacagcacgacgcgatgcccggccttccgggccatgtcgttgatctgatggatccagacatgattgcaggggttgaggatcggccggtccatgaattcgaagcccgtccccagcatctccattggtgacgtgccgtcgttgatcacgcgcacatgatcgacattcggatacagccgggcggtcgccgaggccagcggccattcatcggccatccggtcacgatcgacgaaccggtcgtcatagccggggcggaccgtcgaggtataggccgttacccgacctggcgcgatcagacgcgcggccgtggccgtcaccgacgaactgtcgagcccggaactcagatgggtcgccaccttgtcgcccgcgcctctcagccggcaacgcaccgcccggtccagttcagtgcgcagggcctcggcatattcgtcacggctggacaggcgaagcggcagcggcgcggggttccaccagcgctcggcacggacgccgccatcggccgtcaccaccgcacggtggccgggcagaaggcgttcgatgccttcgaagaaggaattggtccccagctccggcagcagagccaggaagccgttgagccgctccatatcgggcgccatgcgcagccagggcagtgcgagcagaccgcggggcatgctcgccacggcaaagaaccggccaccgccgggcagggttccggcgtggtagtgcagcggcatggcgcccagatggtcgcgggccatcagcaggcggcgttcgcgggtatcccagacgacgaatgcgaaatcaccgtagaaatggtggacgcagtccagctcccagcgctcgaacgccgccatggccagatccgaatccgccatggttttcagccggtcggcgctgatgcccagctcctgcgccagatcctcgcggttatccaggcgcagatcggccaccatcacgaagcggccgccggcgccttccaccggctggcggtcgtaaatgtcttcgggcagcgacgggttgagccgcagcccgatggtgatccggtcgtcgccccacatctgatcccccgcccctggccgggcatgcggggtgtagatggcctgcgcagcaagcatccgggtcagtgcggcatcaccatccgtgttgccgtcgaactgccagaaagcggcgagcgcggtcatgcgcgggtcctccggctcgggagaacggcacggcagatggcagggtcagacaggctcatgaggcaatacgtcccgggaaatgcgaaccggcccggatcatagccgattccgggccggtcacacatcctgtctttaggcgttcatcggccttcaggcgcgccccgagaccaggcggcggaagagctgaaccggccgcgccggctcgggaccatgcggctgcagcaccaggaactcggcccagcgcgcaatcggccggtcatccggtgccgcaaccgtggtgaagccgcaatcgagcagcatgacgaactggtcgggcaggacatggccatgggcgcggatctcgccctcatagcccatgtgctcacgcagcgtgcgggcaatggtgaagccgcggccgtcgcggaatttcgggaaatcgatcaccaccagatcgatggcgtccagcacctcgcgcagccgctcgggccgggcatccgcccccagcgccacgccgcgcgccagctcgtcgcctgcaatctctggcgtgccggcccgggcggccaggaaacgggccagcggcaggatggtttcgggcgaggttaccgcctcgccctcggccgccacctgccagcgatccgcgatcggctgcccctgatcatttagcagagccatagagcgcttccttgaacggggtgatgccgatgcggcgataggtgtcgatgaaggtctcgccggcctcgcggcgggcgacatggacgttgacgatggtctcgatcgcatcgaccacgtcttcatacgagaccgacgggcccaggatctgccccacggccgcctgctcgtccgccgcaccgcccagcgtgatctgataggcttcgacaccgccccggtccaggcccagaatgccgatattaccgatatggtgatggccgcaggcattgatgcagcccgagatgttcagcgtcagccggccgatatcgtgctgccggtccagatcggcgaagcgctcggcgatccgctgggcgacggggatgctgcgggcggtggccagtgcgcagtaatccatgcccgggcaggcgatgatatcgctgaccagcccgatattcgcggtctcgagcccggtgccctgcaaggcctgccacagcgcgtacagcgcgtcctggcggacatggggcagaaccaggttctgttcatgcgccacgcggatctcgccgaaggagtgccggtcggcgagatcggcgaccaggtccatctgcgcatcggtggcatcgcccggaatgccgcccaccggcttcagcgagatcaccgccgagatgtagcccggctgcttgtgcgggttggtgttggtccgcacccaggccgcaaaggccggatccgcggctttcgcgcgctcgaaggcatcggaaacggccggcagggtctcgaaatccgggtcgacgaagcgggcggcgatcgcctcgaccacctccggctcaagccggtagccctcggcatccatcgccgcgaattcttcctcgaccatctcgcggaaacgctcgggcttcgtctcacggaccaggatcttgatccgggccttgtagagattgtcgcgccggccgagggcgttatagacccgcagcaccgcttccatgtagcgcaggaaatccggcaccgccacccagtcggcaaccctggttgccacgatcggcgtgcggcccagcccgccgccgacatggatctcgaacccgatctcgcccgccgcattgcgcttcgccagcacgccgatatcgtgcagccgcacggctgcccggtcattcgggctgccggtgatggcgatcttgaacttgcgcggcaggaaggtgaattccgggtggtcggtcgaccactggcgcaggatttcggcgaagatgcgtggatcgaccacttcgtccgcggccgcccccgcgaactgatcggtggtcacgttgcggatgcagttgccgctggtctggatggcatggatgtcggcatcggccagcacctcgagaatgtcgggcgtgtcgaccagccgcggccagttgaactggatgttctgccgggtggtgaaatggccatagccccggtcatagacccgggcgacataggccagctggcgcatctggtcggaggacagcacgccatagggcacggccacccgcagcatatagccgtgcagctgcagatagaggccgttcatcagccggaaggagcggaactcctcttcggtcagctcgccggcgatgcggcgctccacctgacggcggaagacctcggcgcgatccttcaggaaagcgcggtcctgctcgtcgtaattgtagatgccggcggtcgcgcgatgctgcggccggggggcgtcggtcaccggcggcgccggcggccagccggtctcccccgcctgcttgcccagatcggcacgcacgctggggccacggctgcggatgctctcccgccgggtggtcggcaccgggcggtcgccgtccacctgggccggcgcctcggccaccgagacgacctcctgacgacgctcaccttcggccgcaagcgcacgcccggcctccagcgtgtcgcggtcgaagacggcggcaccatccacccgttccacccagtcaccggcctggttcagccagacggcgacgccgtcggtcaggcggttggcggaaatcacatgcaagctcatgacccgaactcctgctcaccgccggctgcggggaccgtcggtgaaggggcaatccgcgacgacgttgttgtttcgcggcttaatccacacacggagatcatatatacggccaatgccgagaattgcaacgcaatccgatgtgaataaaggtgatgcctgcattgatgccgggacaatctcaccagagataggctcagcccgggccaggcagaaaccttccggtagaaatcccagagaaaaacacacaagccttgtttaatcaggcgtccggggtgtagaggtgctgaaccacctcgacgccgcggagcgcgaagcggccgaccgaggcgacctgctggtccgccccgtccagcgcatcgacgaaggcctgcgacaacagcaggctgcgatcgaccgagcggcacatggcggcgatgcgggcgacctcgtttaccgccgggccgacgacggtgaaatccagccggtcggggccaccgacattgccatagaaaaccgagcccacatgcagggcgagatatagcccggtggagggcaggtccgccccctcgcgcattcgcgccagatcgccgaggccctgccgggccgcagcggcggcggccagcgcccgttccgcggccgcatgacggtcgtcggcagggaagacggccagaatgccgtcgcccatgaacttcaggacttcgccaccctcggcatggatggcggcgaccaccggttcgacatggtcgttcaggaatgggatcacctgatccggcggcaggctgccgctgatccgcgtccagtcgcgcagatcgctgaaccacagcacggcgtcgcgcttttcagcgaccccgcgcacgatccgccccgacatcacctggcgggcgacgtcgcggcccagataggtgcgagcgatggtatgagcgatgccggagagcgaggccgcgcgcatcgccagccccagggacggcatgatcgccagcaccgccgccacctccgcctcgccgaacccatccggatgatcggtgatccacgagacgtagacgcattccatgccacccacaccaatcccgtcgcccccggtgccgccgaagcggacgatggtggccagatagccggtctggccctcggcgcgcagctcggccagatagctgaattcgctgtcggtcgccggcgacagcaggcgcagcaacatcggcgcgccgctctgctccagatgattgaacgggctgttcgcccagctgtccggatcatggtcgcggccataggcgatcaccgccgtctcatcctctccggaccgccagcgaaaggcatgcccttcaaggatcgggtgcagggtgtcgcagaccatgttggcgcgggtcaacggcacacccgccgcccgcaaccgctcggccgtgccgttcagcagcgcctgttcaccgtctccggcaaggccggtgtccaggatccagcggcagatatccccgacgtcgatcgccatgcccggcctctttcgcaaagctccacatcccgaccgcctgatatagactggccgtcggatgataccatgcgcggagccggccgatgtcgcaacgccacctcttcctgcgtcttgcaaccgtcacgcggcgcgaccgccatctggcgacggatcaggtcgccgatgccgtgggcgccgccgggggctggatcgacggccacaaccagttctcgaacaagatgaccacgctgcgtttcaccctgcccgcgggcggtctggtgccgctccgcagccggctggccgatctcaacctggccctgaccgacgaagccgccgccgccctggacgcgaccatcgccgccggccatgccccggaccgcgaggtctcggccagttttcagctgaccttcatccacgacgaaccggatctcaggatcgacattccggccgtgccggggtgatctgcgggtggaaggtcacaccgcctgccagtcgggcgtgcgcagaaagaagcaggtcagattgtattttaccccgcgcaccggcggtgcgccgcggtggagatgggtccagaagggcgggaacaggaccagcaggcctttggtcggcttgatagcgacctgctgatacgggaattcggtgtgcccgccctcttccaccgtgcgcagatagcagagcgccgaaacgaagcggtcataggtgtcgcgcgggccggcgtcgatatgccagccgaagccctggccgggttcgatcttctcgatgatcggcacgctcatccggtggttcgacggcgcggtcatccgcatcacggactggtacttctgcgcataggcgccgagggccttgtagagcgccgcttccaccggcgccatcaggtcgtcccaatgcggcccttccatcgaggccatcacgccgctgcggttggcgctctggcccgcagccgtgcggctggcgaaacggctttcgtcctgttcgaaacgggcgatcaactggtcgcaaagagcgtccggaagggcatggggaaaagcgtcgacgaaggccggctggggcggaggtgccggccgggtcagcggcggatgctggggagcggacatcatcgacaggtccttccgtaatcaccagagacggccaggaaggtggaatcgacggcacatgcccaccttcccggctctccggggaaacatgacagttgtcacaaatgcataacctggaagagcagcctcttctttgggactcatgactcagaatgtcgacccttgtctgagattttcatcacagatcgcgacatgatatgcgatttcctgccctgcaggaaaaaatgtacatagatcacacttcatacatatttgtgacgtaaatcccctctaccggcggtcctggtggagatgcaaacctcatccaaaatagaacaattgaatcgatgataaacttctgagggaatattctggtcggcgccaacgacacaaacaggacgagccgccatgaagacagcccgcttcgtcgcctgcgccctgccgctgctctgcagcagcgcggcgctggcccagacgatcacctatgaaccggccggcacatcaaccgccgtcaccctgccgccgcttcaggccgacagcctgtcgcccacgccgcctgccgatgtgaatggcggggcggcccaggccaatctggtcgatgccgcctatttcgcctggcaggaattcatcgccctgaactggccggccctgaagcagaacggccaggtggtgcgcgacacgcccgacccgtcagcaaccttcggcgaccccaatgccggccctctggtctgggagacctatcgtcacaagatcgagatcttcccgggcagcaattcgccgaacgatccgccccatggcgtgccgcccggcagcaatgatccctggggctacagcacgccgccatcctatgtctattcgccggcgatcttcggcgccggtggcaaggtgccggcctgccccggccagcccgccgtggcccagccggcctggatcaatctggacgagaccagccagatcggccttaccaccatgcatgccggccttctggacggcacgccacccgccagccccaacagcgcgccctcactgatccgctatctggccaaggccaacaaggcggaattcgactacatcgtcaccaaccggctctggtatatcggcaccgacggcaccacgccgctggaacagcgcatcgccgcctggaaggccggcgtggccgcgggcaagcctgcccctgaaaaccaggtcgtcacgctgaacccggggacgatcgaggtcaaatccgcctggcggccgctgctggatcacgagttgaagtccaaccgcttccacaccaacacggtgcgctattacgagccgggacccgacggcaacccctgctggtgggaggcggaatggggtctggttgcgctccacatcatccaaaagaccccgagcgcgccctatttcatcttcgcgaccttcgaacaggccgacaacatcctgcagcccgacggcacgccgatcgaggatgcgagcggcaaaatcgtgcagcagccggtcggcgccacgcccacgacgccttatctcgcctatcaggacaaccccacccaccccttcgtggtgtcgctggacggcaaccagttctgcaacagcccgcagaagcggctctatttccaggaactgccgccgggcgacccttcggttcagccgggcacgccggtcggcggcaatctctgcgtcaatacccgctatgagccgatcaactacacgctgcagcagatcaacaccagcttccagaacagcatccggtcctacatcgccgataagggcctcacttcaacgccctggctgaactacaagctgatcaatgtccaggtggtgccgttcaaccgttcggaagcgctcccctacaacaacaccaatttcataagcccgaagctgcgtagcgccttctatcaagccaatatcacggtcgaaaccgactacaccctgcagcagttcaatggccgcatccatgccgacaatgcgccgaccacctatccggacggcggcaaccagcagaatttccagaacatctacctccgcaatcccggaaatacgtcgttcaccacctatcagatgggcggctgcatgggctgccacggtaatgcccagctcggcggcaccgatttcagcttcatcatcggcggcaatccgctgagcctgaaaccggacacacccgagcccgaaagcgccttcgatgcccgagccttctataccgatcggctgagccgcctgccctcgttcaagcatccgtaatcgcggatcccacagacgacgacacccccgccggtctcccggcgggggtgtcgtctgtcgacgccgatggtgacgatcagaactcgtcgtcggccatcgccatcacggtcttcgcgccggccatggccaccgcgaaggcggccagatgctcgggcagcacctgctccatgaagaagcgggcggtcttgagcttgcgctggtggaagtcgacatcctcgccggcggcgatcttcacggtcgcgacctcggccatcttcgcccacatgaaggcgagcgcgaccagggcgaacatgcgcagatagggcgaggccgcggcccccgcctcgtcgggattggccatggccttctgtgccagaccggccgtcgcctgctgcaggcgctggaaagccttggcgaaggggccgatcaactccttcagcgccggatcagacttcttcgccgcgatataggcatcggccggatggaagaagcggcgcagcagccggcccatcccggccgagagcttgcggccgaccagatccatggcctggatgccgttggtgccctcgtagagctgggtgatgcgggcatcgcggacatactgctccatgccatgctcacggatatagccgtggccgccatagatctgcacgccgcgattggcgttgtcgaaacccagatcggtgaggaaggccttgatgatcggggtcatcagctggaccagatcatccgcctcctgccgcaccgccggatcggggtggtgatgcgagacgtcgatctcggtgccgatccagtaggacagcgcccgcgcgccttcgttcagcgcgcgcatggtcatcagattgcggcgcacatccggatgaaccacgatcgggtcggccgatcggtcgggatatttggtgccggtcagcgcgcggccggacgtgcggtccagcgcataggcaaccgcgccctgataggccgcctcgccgatacccagcccctgcatgccgacggcgagccgcgcgacattcatcatggtgaacattgcctgcaggccgcggtgaggcttgcccaccatccagccgaccgcatcatcgaagttcagcacgcaggtggcagatgccttgatgcccatcttgtgctcgatggcaccgcaggcgacgccgttgcgctccgccggcgcaccattggcgtcggggatgaatttcggcaccaggaacaggctgatgccgcgcgtaccctcaggcgcatccggcagtttggccagcaccagatggatgatgttctcggtcagatcgtgctcaccggccgagatgaagatcttggtgccggtgatgcggaagctgccgtcatcggccggcaccgccttcgtgcggatcagccccagatcggtgccgcaatgcggctcggtcagacacatggtgcccgaccaggtgccgtcggagagcttgggcaggtagcgcgccttcagctcgtccgaggcatgggcggcgatggcgttataggcgccggccgacaggcccggatacatgccgaaggcgagattggccgagcagatcatctcctcgaccacgaagttcagcgtcttgggcagaccctgcccgccatattcgggatgggtggcaagcgccgtccagccaccttcgatgaaggtcgcataggcttccttgaagccacggggcgtgcgcaccacgccgttctcgaaggtgcagccttcctcgtcgcccgggcggttgagcgggaacagctcgttctcgcacatcttcgccgcctcttcgagcacggcatcgaagatgtcgggggtggcatcctcgtagcccggcagccgggaaatccgcgagacgtcgagcacgtcgtgcagcacgaagcggatgtcgcgcagcggtgccttgtaggttgcggccatgggatcggtctcctctccgcagggctcagttgcgcagcggcttgccggtttcgagcatgtgctcgatccgggccagcgtcgcaggcgtcttcagaagcgagatgaaggcctcgcgctccagccgggtcacgtcatcctcgcgcagcgtctcggtgatgtcggtgtcgccgccggacagcacccgggcgagcgcgccagagaccaccacatcatgcggcgtggccttaccctgctggaagaagccgtcgaccgccatctccagcgccacccgtgccgatgggccgggcagcgagatttcggcagcctcgggcttctggtagccctcggccagttccagcgcgcgggctttggcatcggccagcacccggtcgcggttcatggtgatccggtcgcggtcgagcagcagcagcatgtcgcgcgcctcgtcggcgctttccgacaccttcgcggtcgagaccatttcgaagacctggcccaccgccggcatcgggccgcccggacggcgcttgttggccatccagcggaacagcagctccttgcagccgccccagcccggcaccacgccgacgccgacctcgaccaggcccatataggtctcggcatgggcctggacggcatcgcaatggagcaggatttcgcagccgccgcccagcgccatgccggccggcgcgccgaccaccgggaagggcgcgtatttcagcgccttgtaggcttcctggcccatgcggatcatgccgtcgatcatgtcccaggcggcgatgttcgaggcgaagagcgcaaggccgacattggcgccgaccgagaagttgtcggcctcgttatagaccaccagcgccttgtagccgccgcgcacgatctcggtcgacttcgcgaccatctcgagcacgcccggatcgatcgcattcatcttggtgtggaattcgaggcagagcacgccgtcgcccagatcccacaggctggccgacccgttgccgtccacccgcttcgagcgccgcttgacgtcggagagacgcagcacgccttccggcaccggcaccggggcataaccgccggcacgggtggcgaattcgagcacgccgtccgagacccgatagaagcggccggtcccgttgccggcgacggcggccaggatctcgggcaccttgcggccctcggccgtcagccggtcggcgaaccagccggcacccatgcggtcgatcagctcgaacggaccatatttccagccatagccgaggcgcatcgcctcgtcgatcgccggcacctcgtcggcgatcacgccgaccagatcggcggtgtaagagagcgccgccgagatcaccgcccaggcataggcgccaccggcatcctcgtgcgagaccagcgcgcgcagatcctttgcgccggcacggatgctggcgagatcgggcttgcgtttcgcccggtattcgccggtcgaaagatcgagcgcctcctgaacggtctgaccaccgtccttgcgccggcggtagaagccgcccttgcccttccggccggtatagccctcggcgatcatcttccggaacaggtcgctgtcgcggtagatggcgtgataggcgtcatcggccggcagggtcgccttcatgctggcggcgacatggggcatgaggtcgagaccgaccagatcgatcagcccgaacacgccggtcttgggaatgccgaccggcttcgagagcagcgcgtcgaccgcctcgacatcgagcttgcggtccatggcctcggtcaccgccgcctgcatccagaaggtgccgatgcggttggcgatgaagccgggggtatccttgcagtcgaccacgcccttgccgagcgcatggtcgccgaaggcgcggatcgtctccaccgcatccggccgggtctcggggccggcgaccagctccagcagacgcatatagcgcggcgggttgaagaaatgggtgatcaggaaatcgcccttgaacgccgccgaccggtcctcgaccagcaggccgagcggaatggtcgaggtgttcgacgacacgatcgagccgggcttgcgaacctcgtcgagcgtcgcatagagccggcgcttgatgtcgaggttttcgatcaccgcctcgacgatccagtcgacatcggccagctggcccagatcgtcttccagattgccggtggtgacgagcttcgcgcggctcggatgcatgaagctcttgggtttggtcttcagcatcttctggaccgcgccctcggcgagcgcattccggttctcggcgcctttgggcacgatgtcgagcagcaccaccggcacgccggcattggcgatatgggccgcgatgccggcgcccatgacgccggcgccgatcacggccgccttcttgattgcagtcatctcaaagcatctccggtcgcttgggacagccgtctggttcctgcgtcagagcgcttcgaggaccgtggcgatgccctggccgccgccgatgcactgggtggccagcgcatagcgcccgccttcccgcttcagcagcgccgccgccttgccggtgatgcgggcgccggtagcgcccagcggatggccgagggcgatggcgccgccatccaggttcacccgcgccggatcgaggcccagatcctggatgcaggcaagcgcctgcgaggcgaaggcctcgttcagctccacaacgtccagatcaccggcctttacgccggcgcggtccagcgccttgcggctggccgccaccgggccgatgcccatgatctcgggtgcgcagccggcaacggccaccgagcggatgcgggcgagcggggtgaggttgttcttcgccgcatattcttcagtgcagaccaggcaggccgaggcgccgtcggtcaggggcgacgaggtgccggcggtgaccacgccatccttcctgaaggcggggtcgagcccggccagaccctcgaccgaggcgtcgggacggatgcagccgtcggcatcgaccgccgggcccttcttctgggtgatcgcgacgatctcgtcggcaaaccggccctgctcgcgcgctgcggccgccttcttatgcgaggcgacggcgaattcctcctgggcagcgcggctgatctgccacttctcggcgacgttctcggccgtgatgcccatcggcatataggcgccgggcatcatctcggccagcaccgggttcggcgccgggttgaagcccatcattggcacgcgggtcatcgattcgacgccggccgcgatgaaggcttcgcccgcacccagctggatggcgcccgccgccatgtgcaccgactgcatcgacgagccgcagaagcggttgaccgtcgcacctgccaccgattggggcaggccggccagcaggccgatcagacgggcggcattgaagccctgctcaccctcggggaaggcacagcccaggatcaggtcttcgatcgtctcgggatcgatgccgctccgctcgaccaggctcttgaccacctgggctgccagatcgtccggacggaccttggtcagcgcgcccttgcgcgcgaagtggaaaggcgaacgggcatagcccgcgatcacgacgctcttcatgggggccctcggctcctggattgtctctcccgtgcgccggttcgccggcgcgcgtggtttcttggacatgtggtcttacatggtggcgcgggaacaatgacggttccgcgatgcctctggcgacatccgccaatcagccggcggcatcgacgcccttgacggcaagcgccgccagcacctgggcctcgatgtcgcgcagctcgtcgagggtcaccatcaggtcgctcagctggccctggagctgctccatccgctcggtgaccgcactgcgcagctggcgcagctgctccacctgggtgcggtcggcctcgtagaggtccaggaactccttgatctccgccaggctgaatcccagccgcttgccgcgcaggatcagcttcagccgtgcgcggtcgcgataggaatagacccggttcatgccctcccgtgcgggcttgatgaggtgctgatcctcgtagaaccggatcgcccggggcgtgatcgagaactcctcggccagctgggtgatcgtgaaggtgtccggcatgcgctcccccgcttgtgcacaggcccggcgggcctcgggggcggtgccactgccccgggcccggttcttcgcctgtgcggctcttcgcctgtgtgccatcccgacccgggcatgttaattgacgtttacgtaaacgtcaactaactccggatcacgccgttcaaccggccgccttgcggcgcgcctcgtatttctccttctcctcctgcaccagttccttcttcgacagcttgccgatcagggtcttgggcagggcgtcgcggaactcgatctgcttgggcatctcgatcggcgacagccgctccttcaggaaggcggtcagttcggccgcggtcagatgggcgccggccttcagcttcacgaaggccttgaccgtctggccgcgatattcgtcgggaatgccgatgacggtgcattcctccaccagatcatgcagatagaccgcctcttccaccatgcgcggatagacgttgtagccgccggcgatgatcagatccttgatccggtcgacgatgaaggcatagccgtcctcgtccagatagccgacatcgccggtgtgcagccggccgccggccatggtctttgcggtctcttccggtttgttccagtagccggccatcacctggggcccgcggatgcagatttcgccgcggctgccctggggcagcacggtctcgccatcctcaagatcgacgatctcgatcgtggtgcccggcatgggcaggccgatcgagccttccttgctgatgccgttgaacgggttgcaatgggtgacgggcgaggtctcggtcagaccatagccttcgaccagggtgcagccggtcagcttttcgaaggtctgcttcacctccagcggcagcggcgcaccgcccgacaggcagtaattgatcgacgagagatcgaacgcgcggatcttcggatgatgggcgatggccgtgtacatggtcggcacgcccggaaacaggctgggcttcttcttcgccagcgtttccagcacctggtccagttcgaagcgcggcagcatgatcatgcaggcgccggccagcacggaataattcatgcagaccgtcatcgcgaagacatggaacagcggcagcaccaccatggtgcgctcctgccccggacgcgcatccgggaaccaggcctccagctgccgggcattggcgtgcagattggcatgggtcagcatcgcgcccttgggcaggccggtggtgccgccggtatactgcagcaccgccactgcggtttcagggtcgatctgaaccggggcatagcgcccgtcattctgcatcagcgccttgtgctgaacgatccgggcgctcttttcgaccttgccgatctccttacccttcaccagcgggaagagcaggttcttagggaagggcagcacgccggccatggggcagacgatgatccgctccagacaggtcttgcccagcagctcgtgaaccttgtcgtagaccaccgccaggtccagcgtcaccatcacccgggtgccgctgtcattaacctgatgctcgatctcgcgcagcgcatagagcgggttgaagttgacgatcgtggcgccgatggtcagcgccgcatagtagtaaacgatcgaatagggggtgttgggcagaaacagccccacccggtcgccgggcttcacgccgatctgctgcagccctttcgcggcttggccgaccatccgcccgatctcgccgaaggtcaggatcttgcccaggaagtcgaccgccggccgatccgcgaaggtcttgaccgcgtgatccatcagcgatgtcagcggcgcgggcgaaatcgtcttgcgccagttcacgtcggcaggatatttgcgcaaccagaccggctcggctccgccgggatcgatcccggcacccatcatctgtgtcattggtcctcccgagaccttgtcgcgaccccggtgcccgcccctgcccggcccggaccccgtaccgcttccttgatgagccgtcccccaacggcaaaaccggtttccgtatacgtcaaccggccgttcgactatcccaggacacgcgccccggatcaacagtcacgccgcgaaccggcgccggattctttagccggccgcatatgcccggacgcaaccatgggtccgccctcaacccagagttacaatacccgtaatcatgtctcaagacaggtcggaacgatcgggaggattgtcaatcggatcggggcgacgggatggaggccttgccactttccgcagaggcagaaggcctctcgccaggggcggcaaacggagcgacgttcaccgcacccccggccttgcgcatttcggcgatgtcatgggccatctgcatccgcatcagcgtctccatcgccacaccgaacgccttttcgatccgcagcgccatctcaggggacaggcgcgcccgctcattgaccagcgccgacagtgccggccgggtgacaccaagaatgcgcgcagcatctgtcacggtcagttcataaccggccatgatgtcttcacggatgaaggccccggggtgggccggcgacttcagtctcagaccttcaggacggtgcatgatgccggctcctcaatggtaatcctcatagttcagatcgacaatttcgactgcatcgtcgtcgatatagaatgttagccgtcagttgcgagtcaccgacaatgcccagcttcccttccggtcaccggacagtcgatgaggtttccagctggcgacggcaagaagctcatcttcatgagacatggcctgcaggaacgagatcattcgtcggagttttccgagaacggcagggtcgagacctgatggatcatccgactggacgaagcggcgcagacctttgtgaagaatgttcctgatgagcatgatatacccgatcgcctgtgccgtcgtgtgtaaagttacactttacactctctcgacgcggcataatcgcacatcaagatgccgctggactatatatattcgagcctttcagggccactttttgaaatatacatccatatatatcaatcggaaacagaaattatacgtagagaataaatggtcaatccatcttattacttaggtcacgcagcatcttcactgtcgcaaccaccccaagcaccacctgcccgggcacgaaaatcatccgcgccatgccgctgaaggcattggcgtccttgtagatgaagggggtgatctgttcggccgagccgatatggaggtagagataccagccgaggcaggcccggcccagcgtcagagcggcgcaggctgccgccagcagccagccggggcgccccgccagtctgagggtgaggaagaccagcgcgagcaggccgcagacggtcagttcgaccatgaaaaaggcgacgtcgacgatgtcgtaggtcgcatgcatcccctgaggcggggcacgcagcagggccaggaaatccagcacctcgaccagcagaaaggccgcatagccgccataggcggccgtgacgaggccaaggatgcggcgcagggcggcggtcatccgactgccgttatccctggggttggagcgcacgcagccgctccatatggggccgcaccgcctccagctcggccgcggggatcgccatcaccgggcggttcatctcttccgacgggccgtagctctgcagcagctgctgcttctgggcgtcggtcagctggtcgctgtcgcggatccgcgttctcaggacatcgcgctcggcccgcgcggcaaccgatgccgcgctgtcgtaatcgagcgtcagataagcctgcatgatccggtcgccggtcgcggcccaggcagcgagatcggcaaaaccgcgcttcatcatcatggccgaggcctcgtgccattccggcatgccctcgatcgcggcggtcatcgccgcaagatctcggcccggctgcgtcggcgtcgcggcccgatgatcgcggatcgcctggccaatctccgcgcgccgatccggcggcagagcccccgaccaggccgtgaacgcctgccagctgtcgagccagcggctcaccacctcgccggtcaaaggaccgtcctgggcgacagctgcctccccggcggcatgcgcggcgcggggggcggccacgaacgcggtcatcggaagggcggtggcaagcgccagaaccagcaggcggcgggcgatctgcacgggcggatccttgtggcggtgaaggctgggcggtgaaggcaggccgcgcgggccgccgcccgcatggcagcagcccgcccgaaccgtcacggaccggtcattcggtgccgttcatgctccggatgcgctccagatgcggctgcaccgcggcgatgtcggccggatcggccttgccggcctggtccatcatcgccccggcattgcccagcatctgcagcatcatcttcttctgctcggcggtcatgtcgggcgagttcatgatctggctgcgcgccgcctccatctcggcccgctggccctggacgtcctcgccctgcatctcgatcgccatataggcctgcatcacgcggtcgccgacggtcgcccagtcgtcgaggcccgagaagccgtgtttcgagacgatgcccgccgcctgcgccgcctcgggcgcgccggccatgcgcgacacggcggcagagagcatgcgtccgtcggccatatctcccatcatggccgcggggtcgccggccccgtccagcgcctcgcgacggtcttcgggcagggtatcgctccaggcttccagcgcctgcgaagcatcgagccagcggccaaccgtgccgctgtcgaggccggccgcgcgggcggggccggcaaggcccaacggcagcgccacggtcagagccgcaggcagtgccaggggcaacgtcgcggccaggctggccgtggtggcgcggaaggcggccgcggcaaggcggcggcgaaggatcgcggtcatcgtccagacgtctcccatccaggcgggccttctgcccgccggcacgatcggaccggggccccgggccggtggatccggcctcttgcggtcctgatgcgatgcatcacccgactatactgccggaccggcacgcccgcgtcagcggtcgagacgcgcggtcagctcttccgccgcggcggccagacgccggaacggcccctgccctgccggggcaccggcatccgcgcggcccaggcggcgcagaccctcggttccgaaacgatccttgagcgacgacgcgatccagccttcggcctgggccgcgcgccgcggcgccagccggtcttcggcgaccatccagtcgtgatggcggtcggcggcggcgatcagatccccgatcccctcgcccgtcgccgaggcaaccttcagcaccggcaccttccagccgtcagccctgaggcccacggccttgagcgcggttgcgacatcggtgcgggcgcgttccgccgcaggcccgatatcggccttggtcaccaccgccagatccgggatctccatgatccccgccttcatgaactgcaggctgtctcccgaggcgggctggacgcagaacagcaccgtgtcggcgacctcttccacatcggtctcggactggccgacgcctaccgtttcgaccagcaccacatcgaacaccgcgcgcatcagcacggtggcggcgatggtcagatcggcaagcccgcccagccggtcgcgggcggccatggaacggatgaacacgccctggtcttcaggatcggtctggatgcgggtccggtcgccaagcagcgcgcccttggtacgcttcgacgacgggtcgacggcgatcacgcccacgctgcggccctggtcgcgataggaccggatcagggccgaaagcagcgaggatttgccgacgccgggcgggccggtgatgcccagaacccgggcggccggcgcctcgtgcgcggcatcgagcagggccgcggtctcgggccgcccggcccggctttccagctcggcgagcgcacgggccagcgccggcttgccgccgccccggatggcgtcgagacggcggaggccggcagcgctgctgccggcctccatcctgttcccgtcggaaccgcctgtcatgccgctgtcccggccgtcagccgcgggcgcggagcgccgcctgggcggcggccagacgcgcgatcggcacgcggtagggcgagcacgagacgtagtcgaggccggcgcgctggcagaagtcgatcgacgccggatcgccgccatgctcgccgcagatgccgagcttgatgtcggggcgggtcgaacggccgcgctcggccgcgatcttcaccagctcgccgacgccatcctggtccaggctgacgaagggatcctgatcgaagatgccggcctcgcgatagctgtcgaggaaggcgcccgaatcgtcgcggctgatgccgaaggtggtctgggtcaggtcgttggtgccgaagctgaagaactcgcccacctcggcgatcttcgcggcctgaagggcggcgcgcggcagctcgatcatggtgccgaccagatattcgaccttcgcgcccttctcggcaaagaccttggccgccgtgtcgtcgaccagcttgcgcaggatctccagctcgcgacgggtcgcgaccagcgggatcatgatctcaggggtcacggtctggcccagttcggccgagacctcgaccgcggcttccaggatcgcgcgggcctgcatctcgtagatctcgggatacgagatgcccagacggcagccgcgatgacccagcatcgggttgctctcgtgcagggccgaggcgcgggcggccagcttctgcgcgtccatgcccgaggcggcggccacctcggcgatttccttctcgctgtgcggcaggaactcgtgaagcggcgggtcgagcaggcgcaccgtcaccggcaggccggccatgatccggaacagcgagacgaagtcgccgcgctgcatcggcagcagcttggccagcgccgcgcgacggccgtcggcatcgtccgacaggatcatctggcgcaccgcgatgatgcggtcgtcgctgaagaacatgtgctcggtccggcagaggccgatgccctcggcaccgaaggtgcgcgcggtctcggcatccagcggggtctcggcattggtgcggaccttgagggtgcggatctcgtccgcccaggccatcagcgtgccgaaatcgcccgacaggtccggcttgatggtcggcacgcggccgagcatgacctcgcccttgccgccgtcgatggtgatggtctcacccgccttgacggtgacgtcgccgacggtgaactgacccttcgcatagtcgatgcgcacggtgccggcgcccgacacgcaggcgcggcccatgccgcgggcgaccaccgccgcatggctggtcatgccgccgcgggcggtcaggatgccacgggcggcatgcatgccgtggatgtcttcggggctggtctcgatgcggaccaggatgacgtcctcgccgccctgcgcacgcttctcggcctcgtcggcggtgaagaccaccacgcccgacgcggcaccgggagaggccggcagccccttggcgatgacctgcttgggcgccttgggatccagcgtcgggtgcagcagctgatccagcgcctgggcttcgatgcgggccacggcctgctcgtgggtgatcagcccctcttccgccatgtcgaccgcgatcttgagcgcggcggcagcggtgcgcttgccgttgcgggtctgcagcatatagagccggccctgctggaccgtgaactcgatgtcctgcatatcccggtagtgctgctccagccggtccttcacggtgaccagctcggcgaagacctcgggcatctcctcttccatcgagggatcggaggatccgttggcctgcttgccggcaaccgtcaggtgctgcggagtgcggatgcccgccaccacgtcctcgccctgggcgttgaccaggaattcgccgtagaactccttgacaccggtcgaggggttgcgggtgaaggccacgccggtcgcgcagtcatcgcccatgttgccgaacaccattgcctgcacgttgacggcggtgccccattcggcggggatgttgtgcaggcggcgataggtcttggcgcgctggttcatccacgacccgaacaccgcgctgatcgcaccccagagctgctcgcgcgggtcatccgggaacggacgacccagctcgcgctcgacgatcgccttgtagtcatcgatcagcgacttccagtcatcggcggtcatctcggtgtcaagatggtagccgcgctcttccttgcgcgcctccagccggtcctcgaagaagctgtggtcgacgccgagcacgacgtcggaatacatctggatgaagcgacgatagctgtcataggcgaagcgctcgtcgccgctgcggcgggcgaggccttcgaccgtgaccgggctgaggcccaggttcagcaccgtatccatcatgccaggcatcgaggcgcgggcaccggagcggaccgataccagcagagggttctcggcatcgccgaagcgcatgcccatctcggtctcgaccttggccagcgcttccgacacctgcgcctcaagctcggccggatagctctggccgttggcgtaataataggtgcagacctcggtggtgatcgtcagaccgggcggaaccggcaggcccagattgctcatctcggccaggttggcacccttgccgccgagaagattacgcatgtcagcggtgccttcggagccgttgcggccgaaactgtacacccacttggtcatcggtcgactcacccttcgatcttcgaaaaatcggccacggcttccagcgccgcccggatctcggacagcaggtggagccggttgcgccgacgctccggcatatcgcaattgaccgtcacacggtcgaagaacgcgtcgaccggcacccggatccccgccagagccgtcatcgcccgctcgtactcctccccggccagcgccgcagcgatatccgcccgcgcctgcacgagggcgccgtgaagcgccacctcttcgggttcgaccagcagcgccgcatcggcgtcgccaccataggtcgtcccgtccttcttctcttcgatacgcacgatgttgctcgcccgccggtacgccgccagcaggttcgccccatcctcgccgtccaggaacgactgcagggcccgcacgcgcgccagcagccgaacgacatcgtcgtcatccacaccggccagcgtcgccgcgatcagatcatggcgcacgccgcggtcgcgcatcaagaccttcagccgatcggcgaaaaagcccatcagatcgccatgcaggcggtcgatgtcgatctcgcccaggatcggccgatagccttcggccgccgccgaaatcgccgccttgagcggcagacgcacgccggtctcgatcaggatgcgcagcacgccgagcgccgcgcggcgcagcgcgaacggatccttggaccccgtcggcttctcgtcgatcgcgaaaaagccggccagggtgtcgagcttgtcggccagcgccaccgccaccgacaagggggcggtcggcacgccgtccgacgcaccggccggcgcatagtgatcaccgatcgcctgggcgacctcggcgggctcgccgtcatgggtggcgtagtagcgccccatgatgccctggatctcggggaattcgccgaccatgccggtgacgagatcggccttggccagccggcccgcccgctccgccagcgccggatcggcacccggcacatgggccgccagctgccgggccagcgccgcgatccgcccggccttgtcggcgacggtgccgagcttcgcctggaacaggatcgcggacaaccggtcgagacgcgcatccaggcgggtctgacggtcggtgtcccagaagaacttggcgtcggcgaggcgcgcgcgcagcacccgctcgttgccgtgcacgatgaccttcgcgccctcggcgtcgggggcgagattgctcaccagcacgaagaccggcgccagacggccatgggcgtcctcggcgacgaaatagcgctgatgggtgcgcatggccgagaccagaacctcggacggcacatccatgaaggcatcgtcgatgcggccggcgagcacggtcggccattcgaccaggccggccacctcttccagcaggccttcatcggcgcgcagcatcaaccccagatccgaggcgagtgccgcggcgtccgatgcgatcttccgccgccgctcggccgcatccagcaccacatgggcgccggccagcgccgcgcgatagccggcgaagtcgtgcacctcgatcgtggccggcgccaggaagcgatggccctgggtggtgttgcccgcggtcagatggccgaagcggaccggcaccaccgccccgccgaacaggcagaggatcgagcgcagcggccgcacccagcggatctgatgggcgccccagcgcatggatttgggccagggcagatcgccaagtgcgcccgcgatcagctcgggcagcacctcgatggtcgggcggcccgcctcgaacacgtcgaggaaccagaaactgcccttgggcgtctcacgctcgatcagtgacgagcgatcggcattgttggcggcgaggaaccccgccagcgcctgttcgggcgcaccgacccgcggaccgcgacgctcttccgcccggtcgggctgggcgtcggccagatcgtggatcaccagggtcaggcggcgcggggtcgaaaaggcctcggcccggccgaaggtgatccgctgggcggtcagccgctcggtcaccaggcgcgccagatcgtcggcggcccgaccctgcatgcgggcggggatctcttccgacagaagttcgagaagcagttcggccatgggatcaggcctttccggcggcggagacggaggggctgcccgcaatccaggcctcgcagcagcccttggccagcgcccgcacccggccgatataggccgcacgctcggtcacgctgatcacgccgcgcgcgtccagcaggttgaagagatggctggccttgatgcactggtcataggccggctgggccagacgtgccgccagcaggcgggcgcattcggcctcggcgtcggcgaagtgccggaacagcatgcctgtgtcggcgtgctcgaaattgtgcgccgaatagtcgcgctccgccctgaggaagatgtcgccatagcgcacgccgcggtcgttataggccaggtcgtagatgttctccacgccctgaatgaacatcgccaggcgttccaggccataggtcagctcacccgagaccggctcgcattcaatgccgccgacctgctggaaataggtgaactgcgacacctccatgccgtcgcaccagacttcccagccaagcccccaggcgccgagggtcgggctctcccagtcatcctcgacgaagcggatgtcatggaccagcgggtcgatccccagaaccgccaggctgcccagatacagctcctgcaggttctcgggcgacggcttcatgatcacctggaactggtaataatgctgcagccggttgggattctcgccgtaacgaccgtcggacggccggcgcgacggctggacataggccgcattccaggcctcggggccgagtgccctgagcgtggtggccggatggaaagttcctgcgccgacttccatgtcatagggctgcatgatgacgcagccccgctccgaccaatagtgctggagacggagaatgatctcctggaaagacggcgcgcctttgcgctctgtcgccatgctcagcccgctgatgcgtgtcggcaatcctgccgccgaccggttcgtttggtgcggcgcgaacatagccgccggccggttgagggtcaaggatcgcgcgcttcgcgcaagatgcgtgcgcagccgggccaccccgccttccccccgtttccgggggagatgcggcggcgcatctatgattaagggttagttaacgtcttcaatgcacgccacagatgcatcggtctcatccgatcggacagtcggcgcggccacaggggccggcgccgggcactacgaagctgccgcagcgggcgcagcggtcggcatcggccacctcgcgcgcggcccggcggcggcgcggcacatggcgcggttcccgccggtcttcgcggcgaatcgtctcgcgccgctggccgaaaatccgcgccagacgcgccccggtgaacaccgccagcaccaccagcaccagcagcaggatcttcgacaggctgagcatggcctcgtgtcctcagagtccgtagcgcgaccacagcgcgcgggattcgacctgttcgaccagcccggcgacggcggccgaaccggcgcgctcggcctgcagccccagcctgacccggccgaacaggccgctgcgctcttcgatctgcgcgaagcggacctcgtcaccgaagcggctgcgcatcacgctgcgcagatcgcccagcccgtcggccagccccagttccacggcccgggcgccgacccagacatcgccttcgaacagcggcgtgtcgccggctttcccgagccgttccccccggcgctcgcgcaccacctcgatgaagcgctggtgcacctgctcctggatgccgcccagccaggcgatgtcctcgggcttctcgggctggaacggatcgagccgcatcttggaattgcccatggtatagacccggcggtcgagcccgagccgcgccatggcccggtcgaagccgaagccggccgacaccacgccgatcgaaccgaccatcgaggtttcgtcgacgaagatctcgtcgccggccatcgccagccagtagccgccgctcgctgcgacatcctcgacgaaggcgatcaccggcagcttcttttcggcggcccgcgcccggatatgcttccagatcagcgaggactgggccggcgagccgccgggggagttgatcaccagcgccaccgccttcgcctcgggcaccttgaaggcgcgctcgatcagcggcttcacggcctcgtacgacaggttcgcctgaaagctgcggccggacatgatcatgccctcgagccgcagcacggccacgaccggcggcggattgcggaaccgcttcaccggcagcaggcggagcaggcggcggaagcggctgggcttgtcggtcaaggcggcatgtctcccggataaagaggttggggatcatatcgagtggcgggcagcggctgtcaacgccgggagggcgcggcaagaggcagcggcgccgcatcctcaagcacggccccagcctgcagtgtccagtcccgcccctcccccgccagcaccagcggcgccagcagggtgagcggcgtccgccggcccttgcgggcctgaacgatcacccggccggccggccggccgtcgtccaccgtgtgcaccggcagaacgcggatgtcaccggcgggcccggccagcgcggtcaggatctcggccagccggtcggcgcgcatgacgatggtgaagctgccgccgggcttcagccgcctgagcccggccgcgatccaggcgccgaggccggtcccgccctcgacatgggcggcacggcggcccggatccggcggcggatcggcgcggacctcctcgagaaacggcgggttggtcagaacatggtcgaagggctctgtccgcggatcgtccggcccctgcagccgggcaccgacatccgtctccaccacggtcagcgccgcaccggccagcccggcattcacccgcgcaagcgcggccgcaccggcatcgcgttccacgccgaccagtctgagcccgggcacacgggcggcgaggcaaagacttgccgccccggtgccgaggcccagatccagcacccgctgccccggttccgccggcacggcggcggccagcagcaccgggtcgaccgcggcacgatagccgcggatgaactgaacgagttgcacccgtcggcccagaagatgatccaggctgaccgccgacggatcgatgccatgacgggtgagcctgtcctgaagatcgatcggcgtcgccatgttcaccgtctgggccccagcatgcgcgccaccagcccggccagaccgcccgtggcctgcggtgccggccggcgcggcggggccgagatcggcgcggtctcccccagcccctgcgccgcctcgtcgagcaggcggcgggcgcgcggcgccagggcgtcatccaccatcagccggcgcggaaaggcaccgatggaaccttcggccaggctcatctgttcgtcgaagaccaggctgtcgatgccttcggcggccagaaccgcgcgtgcccaggacaggcgcaccggatcggtggtcagcaatacgacatccatcagcggcgatcccgggaaggtgaggtcatggccgcctcccggccaggcgctgaacgaagggcgctgaacggagggcgcggaagggagggggcggaagggagggggcgaagtgaagagacggtgacgggcaccagacagacgcgcagcggcttgtgcaacgcacacgagcgcggcaggatgtgcggcgacacactatacccacccctcgcgtcgctgcgcatcttgaccgcgccgcgcgccacttcatatgctccccagcgccgtgcggagcgtcaagccctgccggccccgggtccaacgttgccctcttttccaacgttgccctgaaacaagacggatcggctgctctctcgtggatgcgcgcgcacattcctcgcaagaggtcctctcgacccttcaggctctggtggcagatgacctgaagcgtgtcaatcaggtcatcatcgacaacatgcagagccaggtggggctcatcccccaactggccggccacatcgtctcgtccggcggcaagcggctcaggccccttctgctgctgatgtcggcccggctctgcggctatgccggcgaccggcatgttcccctcgcagcctgtgtggagttcatccacaccgcaacactgctccacgacgacgtcgtggacgaaagcgagctgcggcgcggcaaggccaccgccaatgcggtcttcggcaataaggccagcgtgctggtcggcgacttcctgttcagccgcgcctttcagctgatgacccgcgacggctctctggaggtgctgcgcatcctgtcggatgcctcggcggtgattgcagagggcgaggtgatgcagctgctcacctccaacgatctggaaaccgacgaagcggcctatctgcgcgtcatcgaaagcaagaccgccaagctgttcgaggccgcctgccagatcggcccggtggtcgccgaccgtccggctgcggatatcgaagcgctggcgcgctacggcatggcgctgggcgtgatcttccagctgaccgacgacctgctggactactcggcagaacaggcggcgctggggaagaccatcggcgacgatttccgcgagggcaagatcaccctgccggtgatcgtggcccacgagcgcggcacggccgaggaacgggccttctggtcccggaccatggaagagctggaccagcgcgagggcgatctggaacaggccatcgaactgatgcgccgccacgacgctttcggcgaaaccctgcgccgcgccgagacttatggcgagatcgcccgcgcctcgctgcagggcttcgcagacgggatcgaacgccgcaccctggacgaactgatctcgttctgcatcgcccgcggattctgatcgaaaacctgcttgcaggggccgccggatcccgctataaggcgccccacggacgcaccggagtgtagctcagcctggtagagcaccgtcttcgggaggcgggggccgcaggttcgaatcctgccactccgaccaacttcggtatgtccgatcgacacgccccggcaggttttcctgccggggcgtcgttgtttcagggtccggtcatcgcataatgccaccacatcggcggtttttttgcggcacggcattttgcgagggcaaatgtcgactcacattgcaacctgatggtgatcgcggcaccatcatgcaatgcatacggatcaaatgtgacgcggtcgtgccacatccccggtctgtcatcctgaaccaccggacccctctctcatggctgacggagaagccctcgacgacacgatggaagaccgcgtgcagcatgccgaccggctgctgcgcatggcggtcaaccggattccggaagcggtgatcatctacgacaccgatgatcgcgtcgccttcgtcaatcaggcctattgcgatttcttcccctatatgcccccggtcggggagctgatgggccagagcttcgaagacgtcatccgccacagcatggtggcaccgggtgtcgtgctcgatccgctggcccggaccgatccggatgcctatatcgccaagcgccgccaccggctgcacaacccgcagccccagcccttcgagcagttgactgccggacgctggcatctggtccgcgaggtcagggtgcagggcgtcggctttttcggcctgcgcagcgacatcaccgacatcaagcagcgcgagatcgagctgaagatggcgcgcgaccatctggcacgccagacccagcagttggcagaagcacgcgaggtggcggtccgcgcccgcgagatcgcgatcgccgcccgcctggaagccgagcgggccaacaccgccaagtctgaattcctggcccgggtcagccacgagctgcgcacgccgctgaacgcgatcctgggcttttccgaaatcatccgcgatcagctgctgggcgatcggtcgccacagcgctatgccgaatacgccgccgacattcaccacgccggctcccatctgctgaagctgatcgacgacatcctcgacatggccaagatcgaggccggccggctggagctgctggtcgacgacgtggatctccatggcctgctgcgcgagttgatgcacacctgccggccactggcccgcaggaacgacaaccggttcgagacccatatccccaacgacatcggcacgctgaaaggcgacgtcacccggctgcggcaggtggtgctgaaccttctgtccaatgcctgcaaattcacccgcggtggcgccgtgaccctggccgcacggcggctcggctcggtcgacggccggagcgatctggtggagatcacggtcaccgacaccggcatcggcatgaccgaggcacagcttgcccgggttttcgaggatttcatccaggccgatgccgcgatcgcccgcacctatggcggcacagggctcggcctgccgatctgccgacgactctgcctgctgatgggtggagatatccgcctggacagcagccccggcagcggtaccaccgcccgggtgatcctgccggtctcaggcccgccctgctccccctccctcccggtcggctgacacagcttgcaactgtaagacgttgcatcccgcgacacgtctccgacagcgcttgccatctctcgcattggttgtttatatagtattcaaaataatattaaggttttaggtgaccgcggccggcagacggatgcggacgaaggggggatgatgtcgtctgacacgccgaccggcggatcgacccgccccggaggggggagcggtctggatccgcgtctcagacgggcacaggcccgtcacgcctttgcgattctggtgctgcccgccatcggcagcctgatcgccatcggcatcgccgtccatgacggtggcgtcccggccgcggccctggtgattctgctcgtgtcctatatggccacctatgccggcatcaccgtcgggctgcaccggctgttcgcccatcgcgccttcgagaccacgccctggctgcgcgcggtgttcgccgtgctcggctgcatggcggcccagggaccggcgatctattgggccgccaatcatcgggtccatcacatccggtcggaccgtgacggcgacccgcacagtccgcggatcgcgaacgggcggcagctgggacgctgggaagggttctggcacgcgcaggccggctggaccttcagccatcgcccggccgatgtcttcgccgtgacccgcgacctgacccgcgatcggcggctgatgtggatcaaccagcgctatctgtggtgggtggccctggggctgatcctgccggcgctcgccggtgcgctcgccatcggcggcatccggggcgcggtgttgggcctgctatggggcggcgcggtgcggctgaccctcagctatcacttcaccaatgcgatcaattcgctcacccacatgatcggcacccggcccttcggcggccggaatacatccaccaatctctggccgatcgccctgccgaccctgggtgaggcctggcacaacaaccaccatgccttccccacctccgcccgcttcggcctggcggtctgggaggtggatatcggctggtggatcatccgcagcctggaagccgtggggcttgcctggaatgtccgccgccccctgcccgagagcataagcgccaagcgcgccgcagccgccgcgggcatgcaggtcgacgacgacgaccgcgtgacggcctgaacgccccgcccggccgccccgattgcggccgcatttcaccccgggggcccgatcggaaattatcgcgctgaacgcgaaattttctctgttcttaggtctatatcatgtgcatatcaacccaagattgagtgttttccagcctctcagacccttccaacgccgggcgcagcccgcagccggagacctgttccatgaacacccagaccacgcttcctggcgcccagcaggccgccgctggtgcccgggcggccacccgccccgatgccgctgccatcgaggcctggctcgtcgactatctggccgaccgcctgggccgcgatcgctctgaaatccgacggaccgaacgcttcgagcgcatgggcgtcgactcgctcgccgtcgtttcgatgaccggcgagctggaagaatggctcggccgtaaggtggagcccacactcgcctatgatcaccccaccgtccaggatcttgcagccgcccttgccggctgaggccgtgccccgaccggagttcgcgccatgtcacctgataccaaccagatccatcccaccagccctgccggcggccaccccggcacgtcgtcggatgcgctgcgctcgcattacgacatcgggaccgacttcttcggtctgtggctcgacccgtcgctgacctattcctgcgcgctctacgaggccggcgataccgatgatccggcgggcttcctggccgcccagacccgcaagctggacttccacatcgaccaggcccatgccgccggcgcagagcgggtgctggatatcggttgcggctgggggtcgatgatgcggcggctggcggaacgcggcgcaggccacgtcaccggcatgaccatgaccgaggcccatcgcacccatgtgacgggcttcggcgatcccaggctcgaggtcgccctgaccccctgggcggggttcgagcccgaggcgccctatgacgccatcgtgtcgctggaggctttcgaacatttcgcccggctggactcgaccgaggcggaaaaaaaggccggctatcgtgccttcttcgaacgcgcccattcctggctgaagcccggcgggcggatgtcgatccagaccatcgtctacggccgggcgaccaaggcggatttcagcaccttctgcgccgccgaggtcttccccgacagcgacctgccgcgcctgcacgagatcatggaaggctgcgaccgcctgttcgaggtggagcgcctgcggtgtgaccgccagatgtatgtccgcaccttccagagctggctcgacgggcttcgggccaatcgcgcggcggccgagaccatcgtcggtcccgccgtggtcgatcggttcgagaagtattgcggcgtgttcatgatcggcttccacaccggcgccatgaatctggcccggatcggcttccgcaaggccggctgagcgaagggggcgtcgatgaccgccgataccaccgccaccaccctggtccaccgccttgaagacctggcccgcaaccgcggcgacgcgctggcctatgtcttcctggccgatggcgagcgcgaacagacccggatcgactatgccgggctcggtgcccgcgcccgggcgatcgcccgcggcctgctggcagtggcggaaccgggagaccgggccctgctgctgcatcagccgggcatggggttcatcgaagcctttttcggctgtctggtcgcgggtctggtggcggtgccggcctatccgccgcgccgcaaccagtcgctcgaccggctgggggcgatcgtctcgggctgtggcgcccgggtgatcctcatcgccgctgaccagcgcgcctggctggaaccccgctttgccgaggccggcgccgagggggccggcgccatcgccgccgcccggatcctggcgaccgacgagatggtgacccggcccgaagacctgctaccgcgtgcacccaccgtcgggcccgacgatctcgccttcctgcaatacacctcgggctcgaccggtgatcccaagggggtgatggtcagccacggcgcgcttgcggccaatcagcggctgatccgccgcgccatgggccacgggcccgaaacggttttcgccggctggctgccgctctatcacgacatggggctggtcgggaacctgctccagccgctctggctgggcatcccgtcggtgctgatggcgcccgccgcctttctgcagaagccgatgcgctggctcagggcgatttccgactggaaggccaccaccgccggcagccccgatttcggctacgacctgtgcgtgcgccgcttccgccccgatctctgcgaagggctggacctgtcgtcgtggaacgtcgcctataacggcgccgagccggtccgggccgagacactggagcgcttcgccgccaccttcgcaccctacggcttccgtgccgacgccttttatccctgctatggcatggccgagacgacgctgatgatctcgggcggcagccagggcatcgcgccgccgatcatcgacgtggacggcggcgcgctcgatctgggccgggtggtgccgccggtcgcgagcgccgtcaccccgccccgccggctggtcggttgcggccagccgggccaggggctggcggtcgcgatcgccgaccccgaaaccggccgccccctgcccgacggccggatcggggaaatcctggtcaccggcaccagcctggcccgcggctactggcggcgccctgagctgaccgacgaggtcttcggcgcccgcctgcccggcgacgaccgccgctggctgcgcaccggcgatctgggctgccggatcgacggcgagctttacgtcaccggccggatcaaggaactgatcatcatccgcggccgcaatcactacccgcaggatgtcgagaccgcgatcaccgccgcctgccccgaccttgccgccggagccgcggctgcggtctcagtagacggaccaggcggcgagacggtggtggcgatgatcgaggccgagcgtgagcgcatgcgccgtctggacgggcccgaaatcttcgccgatgcggtcgaagcggtggcggccgccctggaactgcgcctggagcggctagtgatcctcaggcccaacaccatcctcagaacctcgtcgggcaagatccggcggcgcgagatgcgcgcccggctgctgacgggcctgctcgatccgctctgggacagcgccgcgcgcgaacccgctcgccagcccgaagccgcggaggcgtgacggatggaacctgcctggtcggcgcaagaggagctgcgcatcttccgccatgccgtgcgcggctttctggccacggaattcgtaccccggctcgacgcctggcgcgcgcagggtatcgtcgaccgccagacctggacggcggcgggtgcgatgggcctgctgctgaccgaacacgacccggatctgggcggcggcggcggcagtttcgcgaccgaggcgatcgtctacgaagagctggcgcggatcggcgacacatccttctgcaagggcgtgcatgaatgctgcgcgggctatatccgcgcctatggcacgcccgaacagcagcgccgctggctgccggaccttgccgccgggcggcgcatcggcgccatcgccatgaccgagcccggcaacggatcggatctgaaggcggtgcgcaccaccgcccggccgcagggggaccattatctggtctcgggctccaagaccttcatctccaacggcgcctcggccgatctgatcctgctggtggcgacggtggacccggcggcgggcgcgaaaggcgtcaccctgctggtgctggaaaccgacgacctgcccggcttccgccgcggccggcggcttgccaagatgggccagtgcggccaggacacctcggaactctttttcgacgacatgatcgtgccggccgccaatcggctgggggcggcggatggtctggggttcggccagctgatgtcgcagctggcctatgaacgcctgatcatcgcggtgcaggcggtgacctttgccgagcgcgcgctggcgctcgccgtcgaccatgccatgacccgcgagaccttcggccggccgctgatcgaccatcaggcgctgcgcttctccctggccgatgcccgcaccgaagcccataccggccgggtgctggtcgacgactgcatcgcccgcatcatccagggccggctggacgccgaaaccgcggccatggccaagctctggaccaccgagatgcagggccgtgtggtcgatgcctgcctgcaggtcttcggcggcgcgggctacatggccgaacacccgctggcacagatgtatgtcgatgcccgcgcccagcggatctatgccggctccaacgaggtgatgaaggaaatcgtcgcccgcggtctggcgacattgaaggggtccctgcaatgaccgatatccggccgctcgacgaggcgcgcatggcggaagcccgcgcgctctacgaccacctgaccggcaatggcagccggttcctgcgcgtgggggagctgctgaccgcaggggcggaaacggcccccgggctgctgccggatgcgcagacccttgcagccgaagccgcccggccgctttcggccaaaaccggggtggagatggcccaggcgctgttcctgcaggcgatcttcgccgaccgcgcccgcggcctgcatctttgccatgcgatgcagttgccccgccccgaggccgccgccaatgccgcgcggctcgcccgggacggcgtgctggatctggggctggtccgggtggaacggcacggccggctgctggtggtggagaaccgcaatgccggccggctgaatgccgaggacgtgcccaccatcgacgcgctggaacatgcggtcgatgccgccctgttggacgaggagagcaccgcctgcatcctgcgcggcggcgtggtcgaccatccccgctatgccgggcgccggctggcgggggccgggctgaacctcaccgatctctacgagggccgcgtgccctatgtgatgtatatcgagcgcgaaatgggctgggtcgccaaggtcttccgcggcctggcggcccccgaccgcctgcccgacgaactggccgagacgcgcgagaaggcctggatcggggtgatcgacggcttcgcgatcggcgcggccacccaggcgctgctggtctgcgacgcggtggtggcagaggccggcagctggttcaacgtgcccgcccgcaaggaagggctggtgccggggtgcaccaatctgcgcctgccgcggatcatgggcgaccggctggcccgccagatcatcatgaacggccgcaccatccgcgtggacgagcccgaagcccggctgctgatcgaccgcgtggccgaacccgacgggctggagacggcgatcgacgaggtggcggccgatctggtcgatggcggcgtggtctcgatcgccggcaaccgccgcgccttccgggtggcccaggaaccgctggacctgttccgcgcctatcttgcaatctatacccgcgaggtggcggtctgccatctgagcccggcgctggttgccaatctggaacggcactggaccgggcggaaggcgcgcggctgagcgcctcaggcagtggcgacccagccccgccaggtgaaggcggcgaaaaacaggctgacgtcgcggaagccgccctcctccaggatcgcggtgtcggtggcggggtcaaaggtcatcaggctgcggcgcaccgcttcgcaggcaccattggtctgttcgacatccgcgcccatcgacaccgcataggcggcatagcgcgacaaccagagatcgcgttccgccgcctcttgcggaaagctggaatgggcggcgacgaacggcgcaccgggcaccaggcggcggtggatctccgccaccgtccgtcggcgttcggccgcgtccagaaaatgcagggtcagcaggcaggttgcggcatcgaagggcccctcgggtgcatcgtcgatatggccctcgaccagatcgacccgcgcggccagcttccccagcgtgcggcgggccagccccagcatttcggatgatggatccacgccggtgaagcgccagccgggctgtgcctcggccatggccttcagctccagcccgcccccggcgcccagcaccaggatccgggcatcggccggcacccgttcggccagcaacagccaggtcatgcggtgcagcgcctccagccccggcacgaagcgccgcgggccgtcggcataggcggccaccgcctcggggttgcagaaatggctgacgagatcggccgtgccgccatcggcaggggtgtccgacatgagatgctgtcctccggatcctaattcgtaacttacgatgatacgaatatggatgaaggtcaacaggggggatcgcgcggcggcggcggtcgggtcagaccgcctcggccggggtgtcgaacaggaaacagccggtgatgcggtgccggccgtcgatcacttccagcgtgtagaccgccatcaccaccccgcctttacgggtctgcagtatggcccgctggacgaagcggccgtcggcaaggcgccaggccgggccgtaatccacccgcacgggccggatgaccgccggataggcatggtgcaccatgcgcaggaagcggtcgggcgtgccgaaccgggcctgaagggcgggtgccgccatggcgaaggcggcggcggcatcgtcgcgggccaacgccgcaagctgacggtcgatggccgcgatcaccgccgaccgctcggccgtatcggccgccacggccacgggagccgcggtccgggccggatgatccgcccgcgggtgatcggccgcaaccaccaccagcgccgtgccgatcagcagcgatgccgcgatcttgatccacccccggcccatggccggcaagccttgctgacgggacatctccgggcctcccccctgtcgccgcgcgcgcaccccatgttcatgacatggggtgccgcgggggaagatccagggtgatcaggcagttgcaaggtgcggctggcgaaggcccaggagctgaagctcggccagcatcgccaccaccaccgcctggccgatgaccaacgcatagccggggcccgttggctccacccagcccagaaccagaagggcgatgctgtcgacgacccagagcaggttcaggatggcgagcgtgcgcaccgccttgcgaggcagcggatcgcgcgtcgcaatcagcagaatgccgcccgcgatcacgacgagggcgataccggtagcggccagcagcccgcgcggcaggccagtcagttcggcgaccgggccgccggcgatcaggaacagggcagccatgccaagcccgctcagggcatcgaaccagagcacgcggcgcagcagggtcgggttgacggtcatgacgggtctccttcagggagcagtgccggacggggccccttgcccgccgtcctgcccccatcagacaccggcgatcccccgccggcgattatgccggaggtaatgatcacgatgacgttatgcccccttgtcatgaggctttgtcatgaggctttcatcgatgtggccgcatcatgacccgcgacgaaaccggaaacgctccccatatatagtcgtcccacccgaggccgcagctcttgcggccaccttcggaacggacaggaaaacatgaccgatgccgagcttcatggctgcctcgactttatccgtcagactgaaaagctgaaggacgtcctgcgcaattcctacaccgcctccggccgccacgagagcactgcggagcacagctggcgtctggccctgatggcgatggtgctgggcccggatctgggccgggatggcgagccggtcgacctgctgcgcgtgctgaagctctgcctgatccacgacctgggcgaggcgatcggcggcgatgtgccggcgatccggcagaccggcggaccagacaaggcggcgcaggaacgcgccgacctgatcactcttctggaaccgcttgatgccgcacgccgcgccgaattcctggcgctctgggacgaatacgaagcgagctcgacccctgaggcccggatggtcaaggcgctggacaagatggaaaccatcatccagcacaatcagggtgccaccgcccccgatttcgatcatggattcaacctggattacggtcgccactatgccgagggccacccgctgctggcccggctgcgctgtctggtcgatgccgacacccgcgcacggatggcggaggcaaccccgccgccccggcgcaccggctcggaggggtgatcggccaccgcctcaatccggcatgacctgatcgggcatgacctgatcgaccatggccagcagctcgtcgcgcccggcgccgtcgcgggcctggatcgacatgccctggatgacggcgccgtaaagccgggcgagcgccccggcatcggttcccgcaggccagcgcccggcagcgatgccgcggcggatgcaggcggcgatggccgcaatggtatcgcggcgcagccgtgcggtctccgccgccaccgcgtcgtgctcgggcgcgcaggtgatcagggcggtggagatcaggcagccggcgggttggccgggatcggtgaaggcgatggcggtttcgcgcagcagccgccggatcgccgcccgggggtcgggctcctcgtccagcgcgcggatcgtgaacagccccggccccgcgcgataggcagccatcacctcgcgatacagctcttccttcgacccgaaagcggcgtagaggctgggcggggtgatgcccatcgcctgggtcaggtcggcaaccgaggtgccctcatacccccgttcccagaacaggcgcatggctttggccagggccgcatcacgatcgaagctgcgcgggcggccacggccctgacgcggggtcggggatggggatgacgggcttttcatagcgatcgatatatatttctgttgcgcggggacaggcatctgctcattaatatagcgactgctatttaaatggagaagcgccatgcgcagcctgtccgtcgccgcatcccttgcggcggtcacgctccccctcgccctgacgccggccgcagccgacgacaagactaaggccgacaagaccacgggagagaagaccttgggcgcccggatcgaccgggtggtcgacacggcgatcgccgaggggcagatcgccggtgccgtgatcctggtcgccgaggacggtcggctgatccatcgccgcgccgccggccatctggaccgcgaggcgggcctgccgatgcgcgaggatgcgatcttccgcttcgcctcggtcagcaagcccttcgtggcggcaacagcattggccctggtcgatgacggggttctggacctcgacacgccgatcacccgccatctgccggatttccgtccggcgaccggcgacggcgaccggccggtcatcaccctgcgccagctgttgagccataccgccgggctcgattacggtttcttccagccggccgacggcccctatgcccgggcgggggtctcggacgggatggatgaccgtcccggcctgaccctggctgaaaacctgcgtcgactcgccatggcacctctgcgcaaccgcccgggcgcggcctggcattactcgctggcaatcgacgtgaccggcgggctgatcgaggctgcaaccggccgcaccctgcccgatgtggtccgcgagaaggtgaccgcaccgctcggccttgaagacaccggcttcaccgtcgccgacaccacgcggctggcggtgccctatgtcgacggcccagagggcggcgtaccgcggcggatggcggcggccgaagcggtgccctttggcggcagcgccgtgcattacgcgcccggccgcatcctcgatcccgatgcctggccctcgggcggtgccggcatggcgggcaccgccgccgatgtcctggcgttgctggaagccatccgcaccggcggcggcggggtgttgagccccgggatggccgcagccttcgtccgcccgaccaccggcgacctgcccctcgatgtgacgggccccggctgggccttcgggcttggtgcctcggtgctgatcgacccggcccttgccggcagcccgcaaagcccgggcacatgggcctggggtggtgcttatggccattcctggttcgtcgatccggtccgcaaactgaccgtcgtggcgatgaccaacaccgccctcgccggcatgaccggggcttttcccgacgcgctgcgcgatgcgatctatgccgactgaccagccccgccctcacaaaccccactctcgggccagagggccgcagccgttcgggccacgatggccggcacggtgtcgccgggcgcgatggccagccggccgtcgatgatcagcatcgacagcccatggaccagcgcccagcgcgcccgggccagatcgggatcgatgtcgggggtggcccccatcgcatgggcggcttcggcatcggcggcgatcagctgtttctgggccggatcgagcggcccgaccatcaaccgaaacaagcccggatttacgcaagcgaagccgacataggcctgcgcctgcgccaatgatcgcgaccggggatcaaccccctgatcggccgcgcctttcagcgccgcccccagctcgcgaaagccctgcgcggccagctcggcgagcagcgcctcgcggttctccacatggcgatagggcgccatggccgaaacgcccgcctggcgtgccacctcgcgcagcgacagccggtcatggccgtccgcctcgaccaggcggcgggcggccgcgatcagcaccggcttcagatcgccgtgatgatagccgtcggagtgtcgtgccgcacccgtctcccccattgacgtccctctccttcgccctaatgtttacaatgtaaacatacgaggggcggccagtccagtcgccggcaagagacagggtcaaggggtcgaggcattatgatcgtcgtgcatcatctgaacaattcgcgctcgcagcgcgtgctctggctgttggaagagctggggctcgactacgagatccggcgctatgagcgcgacccggcaaccatggaggcgccggccagcctgaaggcggtgcatccgctgggcaagtcgccggtgatcaccgatggcgacgtcaccgtggccgagaccggcgccatcgtcgactacatcctggagcgctatggcgagggccggctggtgccggccgccggcacgccggagcggctgcgctggcgctattggatgcattatgccgaaggctcggcgatgccgctgctggtgatgaagctggtgctgatgcgcgcccccgaccgcaccccggcactgatccggccgctggcgcgcaagatcaccggcgcgatcaatgccggcttcgtcgacccccggctcaacaccaacctcgccttctgggaagcggaactcgcccgcggcccctggttcgccgggcccgacttcaccaccgccgacatcatgatgagcttcccggccgaagtgtcggcacagcggatcgaaggcgcgcgcaacgccacacgcgtgcaggatttcgtgaaacgcatccacgcccgcccggccttccgccgcgccctggagcgcggcggcgcctatgcctatgccgactgacgcccgcccgaaagccccgcgccccctctgaaggtccccgctcccgcacgggaccgtgcgggagcaagccgccattgaggcggcggccaagggcgcggaagcgcccgcccggcgaggggctattaaagactcccgccattgaggcggcggccaagggcgcggaagcgcccgcccggcgaggggctattaaagactcccgccattgcggcggcggccaaggggtgcggaagcaccccgcccggcgagggaccacaaagactactccatccaggcgacgtcggtgatgggcgccggtgcgccatccaccgggcgaagcggcgtggcgttgccggtggccagatccagtttgtggatcaccccgccattgaccatccagccggcctcgccgcccatctcggtcgagacgatgttgaaggcgatggggctgtcgacggtgacgcccagccggccgatcgcggtcagcacgccgtcattcggcggtgcctgcttcaccagggcgccgatcgtggcgtcgatgtcgtaaagcgcggtggcttcggccttccggccggtgcgcgaattggtataggcgccggccacgatgttcggggtctcgcccttgtgcatgtcggcataggcgagccggccatcgaccaccgccttgccgtcgtcgacattgaccctgagattggtgccgtcgggcgtcatcacccgcagccggtcggcggccgggttgaaatcgaccgtcacaccatggcgggccgacagcttctccgacagggtcgcccgcaccgtcgcctcgccggtgccgggatcgatggtgacgatccggccatcgcccgccaggccgtagagccggccatccgctggccggacatcgatgccgaccaggccgggcacgcccgaaatcggaaccatgccggtcaccttgccggtggccgggtcgatctgcaccagactgctgtcgcccgcaagccccaccagcatgccggcggaggccgtggtcatgcccggcatcatcgccagcatcggcagggccagagcggccgtggcagcagcccgggcggcgccggtcttcaggtattgaaagcgtgtcatggtcggcgtctccctctcgttcgggggcggcgtcgacgggacgatcaggccccgctccacccatcagggaaacaacgctgcgaccggtcgggacggatgcacggtcgtggcggatttttccgtccaggcctgcccgggctgccggcgggcgggccgggttggacattctgcaatgcattatttcaaacgttcaattgactcacgagaaactttcccctacataagacctgcgctcacgaaaggatcggtcaggaaacccggcggacactgtcggaaacggccggtccctgttgaacgccctgatgactggcaattcggcggcgcaggctgcgtctccccggcagatccgccgccgttgctcatccgtcatcggtccccctcctctcccccatgagtgagcggtgacggatgtcgtctcggacgcccggcccctggtggcccgggcgtcctttttttggccctcgccgggcgggcgctccgcgcctttggccgccgccgcaatggcggggggagcttgcggggacgagtggagcctcaggaacaacgatctgagatgtcggcgtcagccgatgggggcggtcaggccggagatgcggatggggctgccgggttcggggccgaagctggcgtggatcaggctggggcggcccatgtcttcgccctgcaccacctggatcgccccctcctccagccagcggatgtcgcgcagatagccggccagcgccgccgccgccgcgccggttgccgggtcctcgtagaccccgccgatggcgaaggggttgcgggcgtggaagcgggtgcggctttccgcggtcacgaagatgaaggtggcaagcgactgttccgcctgcagcgccgcaccgcgccggaaggcataacccagctgcgacaggcggcggcgatccttcagcgccaccaccagatggttggcaccggcatggatcaggcgcaccggcagatgcgggtccaggtcggcgtccgtcagcccgaattcctccagcacgcgccgcacataatccgccggcggcagccgggtccaggtcggcggcgaggtcagcgccgcggcccagccatcgccttccgggatcgcctcgaccgtgatccggccggcattgagggtaagatcatagacccccgcccccatccgcgcaccgagtgccgccccgagcgcgatggtggcatggccgcagaacggcacctcctggcgcggcgcgaaatagcgcacccgccagccgcccgctgccccgccctgatcgggaaccgcaaaggcggtttcggaatagccgaccgccttcgacacggccagcatctcggtctcggtcggccagctgtcggcaaagaccaccccggccgggttgccgccgtcggcatcgatggtggtccgggtgaaggcggcgatcttcagcaccgtatcgggggtcatgagcgtcactccggttgcagctgcattgaggatgaccgtatgatggtgacacttggcgctcaatctctatagtgtcacggtacactttcagccgaaaggcaggacacgaatgcggcgcccctcggactggaccccccgcctggctgcgggtgacggcgcgctggccgagcggctggccgcagcccttgccgacgacatcgcccgcggccgcatcgccccgggcgaccggctgccggcccatcgcgatctggcctggcgactggaaatcggcctcggcacagtcacccgcgcctatgccctgttggaacggcgcgggctggtggtgcccgaacgcggccgcggcatgttcgtggcggtgccgcccgcccaggccccagggccggtggatctgtgcgtcaacacgccgccgcgcatgctcgatacccaggcgcttcgtgcctctctggcccggctggcggcacggatcgacatgtcgggtttcggcagctacacgccctccgccggcacgccgcagcatcgggcgatgatggcgcgctggctggcccgcgaccggctggagctgccgccgtcgcggctgatgctcacctcgggcgcccagcatgccctggcggtggcgatcgccaccaccaccggcggccggccgggcacgatcctgaccgaaagcctgacctatcccggcatcatcaccatcgcccgccatgccggccaccggctgcaaccggtcatggttgatgaccagggcatgtgccccgacgcgctggaccgcgcccttcacacggcactgcgggatgggcgccccggacagcggctgatctacgtcacccccaccctccacaaccccaccgcagccagcatgagccgcacccggcgcgaggcgatcctcagcgttgccgcagcccatgatgcggtgatcgtggaggacgacgtctatggcgtgtttgccgcgggcgacatgccgccgctcaccgcactcgcgcccgatcgctgcctctatgtctcgggcctgtcgaagagcctgagcccggggctgcgcatcggtgccctggcggtgccgcccgccttcctggaagccgcggccgatgcgcttgccgccagcgcgaccatggccccgccgctcggctgcctgctgatggaaagctggctggaagacggaactgcagaggccgtggagcaggccgtccgggcggaaagccgcgcgcgcaccaccctcgcccgccggctgctcggcaaacatgtcgcgccccaggaaacacccggctttcacatctggctgccgatgccgcgcccgcgtgccgaagccctggccatggccgctgccacccgcggcatccgcgtcactccaccctcggcaccgatggtcgatgatcacccgggcgcccctgcgggcctgcgcctctgcctgggcgggccatcagccgaggcgttgaccaccgccctcaacgacatcgcccgtcttgttgaggaacgggacacggatccggctgcctatgttgcaatttaggccagacaacgggaagaagtgacgaccaacatacgctatgatgcgtcgcaggcccccgacggatgggacgatgagcccaacagcctgcaaggacatcatcatgcgcggatcgatcagacatcatgcggccgcggctgtcatgggtgcggttgccttcctgtcggcagccacggccgatgccaaaagcctggatttcgacgtcacggcctacaccgacaaccagacgctgcatccaagcttctattgcgagcagaccggcgggtccagcaccacgctctcctacccctacaaggcttcgggtatcgagttcatggggacgacagagtcgggcacctgcgacgtctccacctatctggagccgcacagcgccttcaatttccacgccatggccggcagcaccagcgcccgggaagtctcctatcagatcaatctctacaatgacgagatcgagggtacccagatcacgcagcaggcggcgcagttcttcacctacggcaatgcgtcctatgtgctgaattatggcatcaccgacctgccgatgccgttcaacgacacagcctatctctatatcggcaacgaccagtcggactggatggcggaactgaccggcagcagcggctatgccgacatcaccttcggtgatctggtcctgcccgccgcgcatgatgccggcatgttccagatttcggacagcaacgccgccaccagcaatctgaaaggggtgtgcggcaccaacgtgccggccgagttcaacttcctgtgccaggaggcggagtacggcgcaaccgcgcttcagaacgcatcgctgacccagaaagatgtgatctacgaccagctgcgcatcggtacccgctatttcgacatccgcccgggctatccgatcggcgatgccaaggccaacgacaccaacaccacccatatccacaacttcattccgggcgcaccgctcgccggcatgctggacgacgtctcgcgcttcctgggtgaacataccggtgaaatcgtcgtgctgcggatccagagcaacggcatcgatcacggctactatcaattcatctccagcacggatctgaccgcggcgctggatcgccatatcgccgccggcatcggctatcgcctggtcgatgacctctcgaccctttcgggccagtcgttgaaatcaatcgtcggcgccggcaaacgggtgatcgtggtctatggtgcggagaaatccgcaaccaacccgacaggcatccctgacatcaacgacagctatgacgataacgactatcaggcgtcgatccacagccccacagcggtcaacggcgacgttgccaccacgctgcaggcctgttccggcggcggggcccaatacacgctgctgcaattgcaggacaccgccagcggcgcattgctgccattctacacccagacgcagtacacccctctgatcctcgatgcgtcagaggtgatcggcaacagtgacttcggcaacatcctgcagggcaccaagccctggttcgatgcggtcaactatccctggctgcagagcagcgccgcgctggccagcctcgtcgcctgccacatgccggtggtgatccagaatgatttcgtggatgtggccctcacctcgcatgcgatcggcctgtccaaataccgccacgataattgaacccggcggtcagggccggtggcaccgggtgatcgcacgatagtccttgcgcggtccccgcacccggatgtcggtggtgaacgcccgcggcagctccagcgttatgctggcctcgtagagatcggcgccgcagagatggctgtcggccgcctgcaggccgcccgcgtcatcggccgcgaaatccagcgtgacgaagcgggcgccgggggtggcaccgtcggcgaaatcgatcgcgatccggccatcgcccagcagccgccaggtataggctcgaaaaacatcgagccggcggccatcgggcagttccagcgtgccggtctcgcgataatgcagcgcccagcgatcgtcgccgggggtgaacaccgccccgccgctcatccggccctggtcagggatctctcgggcaagccgccaagccccggcaagtcccgcaaaagctgccgccgcatccacccgtctcagtcctcctgctgctggctgaagccctcctggccaaggcctccttggccaaaggcatcctgaccgaacagcaccgccacttcggccagggtaccgagggcgatgtcgggtcgggcatgccggccgctcagccgatattgcgccggaagcaccggtccatgccagaggaagcggccaagcccggtgccgtcatggagcagatcgggcatcacccccagcttttccgccagcgcatcacacatggcgggatagtcggcatgggggaattgcggccgcggccggacatcgcggatcgtccgttccgcggcaaccgcgcgctccagatcgagcgggtctggccggggcagtttccccgccagcaccgccgccgcccagcgcgcctgaagctccatcaccccgaaataggggccgcgatacatgccgacaaaggccagatcgggcacaccctcagggaagacgcaatggccgagcagaaccggttgcagccggtcatgagggtcgtaaccgatcgcctccagaatgcccggggccagcatggcgagagaggggcgatagccggtggcacagatcagcacgtcgaaccggctctcgcgcccaccttcctgcagcgtgagcctggccgggtcgaaatccaccgcccgtgccagctccagccgccccgaccgtaccgctgccggcagggcatccgaaatcaccatcggcgccgccaggtcgtcctcaggcacatcgagcagcgggtgcaggcggcgctggtcaccggcgatgccgtagagccaggaccagcgttcccgcccggcggtcgccccgtccagcgcggccaggcgctgggcccgtgcgcgggaattgatcaccagatccatcggcagacgcaggcggatgcggtcgtcgccggcatcggccggcatgaagcccgcctcgggcagcaccggcaccgcccgcggcacataccaggccggccgacgcatcagcatcaccgtgcgctcggccaccccggcaatctcggcggcgatgtcggccccggaaaaggcgctgcccagcaccgccacccgctttccggcaaagacggccgggtcgcgataggcggcggcatgcatcaccgccccgccgatcgtcaacccctggggcatcagcgcctcggcgaagacgcccgaggccacgatcaccgcatcggtgtcgtgggtctcgatccgtccgtccgcttccaccatcaggcggaaaccgggggtgcgcgggatcaccgccatcacccggtggccggggcggatcgcctcgtccaggccgaaacgggcggcatagccggcaagataggcggcgacccgccgcccctcggggaaaagcggcgtggtccgatcatggggatggtcggaaaagacgcagctgtagcgcgacagattggtgcggaggctgttccagaccaggccgggctcggtccatagcccgcccggcctgtccttggcttcgaaggcgaccgcttccagcccctcttcccgcgcggatttgagcgcggcaagacctgcgggccccgccccgatgatcgcgaccctgcgtgccaattgcccgtccctcatccctcggtcgatgccgtgtccggaaacctccgccataaatcaggcagcctgatcctgaggcgcgatcatccatgaatgatcataaaccagacgtcaccagagatgcgagagccgagggacgggaaagttcagccgaggcgcgccaggatctgatcctcggccaccgtgtcgccctcggcgaccaggatttcggtcacggtgccgtccaccggcgcattgaccgggatctccatcttcatcgattccaggatcaggatcggctcgtcggccgcaacccggccaccggccggcacctcgatcttccacaccttgccggcgatctcgctgcggatcacggtatcggccatggcacgtctcctctgttgtctttttgggggatggtcttcggacggcatccggtcaggacgccaggatcttggccgtcagaccggtatgaacccggccggcgcggaaggctggatggccgatggcacggcgcaggaaggggatgttggtccggatgccctcgatgacgaagccggccaatgcggcatccagccggtccagcgcctcgtcgcgggtggcgccgcgcgcgatcactttggcgaccagaggatcgtagaacggcgtcacccggccgccctcgcgatagccggtatagacccggacggcctcggcgacggggggcgcgaaacgggtcagccggccggccgagggcaggaagcgcacgggatcttcggcatagatgcgggcctgcacggcatggccgcgcgcctcgggccgccggggcagaacctggtccagcggctcgcccagagccaggcggatctgggcggcgacgatgtcggtgccggtcacctcctcggtgacggcgtgttccacctgcagccgggtgttgacctcgaggaaggcgaagcccgtgccttcctcccacaacatctcgaccgtgccgagattgtcgtagccgagcgcccccatcatgccggcgatgcgatcgcccagcgccctgacttcgccccggtcgagcccgggggccggcgcctcctcgatcaccttctggtggcggcgctgcagcgagcagtcccgttcggacaggcagaccgccccgccccggccatcggccaggatctggaattccacatggcgcggccgttccatcaaccgctccagatagatctcggccgagccgaaactgcgcgcggccatggtccgcgcccgctccagcgccttgtcgagttccgccgcatcgcgcgccgccagcatgccgatcccgccgccgccctgggcgggcttgaccagcaccggatagccgatggcatcggcggcggcacgggcctcggccggatccgcgcccagaaggccgctgctcgcccccatcggcatgccctgtccggccatcagccggcgggccccggtcttgtggcccatcgcctccagccagcgggcatcggggccgatgaagcagagcccggccgcgcgcaccgcggtggcgaaggcggggttttccgacaggaagccatagcccggatgcaccgcggtcgccccggtggcggccgctgcctccagcagtttcgggatcgacagatagctgtcggccggtgtctcgccacccagcgcatagacgtcatcggccaggtccagccagcccccctcggcatcggcgtcggaatggaccaccgccacgcccagccccaggcgccggcagctttcgatgacgcgcggcaccaccgcgccccgattggcgatcaggaccttggcagacatgggcgtttccccggcagattattttaaacgtttgtttgtgttgaaaggctagcccatgccccggggtgagacaagcgccatccccatcccatcctcgacggaattgacaggaataatgttatgttattacattgcaggcatgattgatgccgccgccctgccccatcctctgtcgcccaaggtcacgctcctgcgtccgcatgcagagagcgcccccgctctgccgtatctgccgggtgtggtggtcaccagctgcgaccgcgcgccaggcctggcgctggccgcgcgtgacaccgcgatcggcatctggtggcgggatccgccgccggtggtggcactgctggatcaggcggcagatgccgccctgcccgacgggcggctgaccgtcggggcggatcccgcaacgatcgccgcggccgcggaggacctggtcggcaccggcagtctggcactcccgacggcgcaggcgctgatcgccgacctgacccaggtgctgacgcgcttcgccgccgtctcgcgggcccgtcatctggcgatccggctggaggtggtgtcgggcccggcctgccggcgctttcatcaggaccatgtccgggcgcggctgctgtgcagctatcgcggccccggtaccgagctggcccccgagaccgtggaccgggattcagggtcggcggccctgtgcctgggcaccggccatgtggcggtgctgcgcggccatcgccacccgctgggggccggccgggtgctgcaccgctcgccccagggcgtgaccggccggcggctgttgctcgcggccgatgccgaccccgactgaagctgcggaccgatcacagctgccgattgatccggggcgccggcttcccgacaatggcggggtccgccacccaggaaggccccggcatgagcaccgcccgcgcacggacgacggcccacaaggccgcctctttcggtgacctgctgcgcgactggcgccagcgccgccggttgagccagctggcgctggccagcgaggccgggatctccacccgccatctcagcttcatcgagaccggccgcgccatgccgagcaggaccatggtcctcaggctggccgaacagctggaggtgccgctgcgcgagcgcaacgcgctgctggtcgcggccggccatgcgccggaattcgtcgagcgccgcctggacgatccggcgctcggcccggcgcgacgggcggtcgatctggtgctgaaggcccatgagcctttcccggcgatcgcgctggaccggcactggacgatcatcgccaccaatgatgcggtggcgccgatactggaaggggtggcgccgcatcttctggccggcgccatcaatgtgatgcggctgtcgctgcaccccgaagggctggcgccgcggatcctgaacctggccgaggtccgcgcccatctgctcgaccggctgcgccggcagatcgacatgagcgccgacccggtgctgatcgatctgatggccgaggtgaaatcctggccggcgccgatccatatcgccactgccgccctcgcccacgacccctatggcggactggtggtgccggtgaagctggcgagcccggccggcccgctcaccctgttcagcaccaccaccgtcttcggctcgccgctcgacatcacgcttgccgaacttgcgatcgagactttctttcccggcgatgaagcaacggcccgggccttccgcggtcagcgaccgtagcgcacctccagcacggccttatccagcgcatgggcgttggcgaaaaagccgatcagggccggcatggcctcgggcgtcgccaccggcagggcctccatgcccagcgccgtcagggtgaagacatagcgatgctcgcgcccctcgggcgggcaggcgccgccatagccggggaggccgaaatcggtgcgggtttcgaccgcaccggcgggcaggcgtgcggcattgcccgaggcgccggtatcgaggccctgcgcatcggccggaatattcgccaccacccaatgggtccagccgatgccggtgggggcatccggatcgtgcaccgtcagcacgaagctgcgggtgccggcgggcgccccctcccaggtcagcgcgggagaccggttgtcgccgtcgcagccgaagccgtatgcggccgaaagcacctgcgcggccggcatccggccatcgggcatgtcggggctggtcaggcggaagtcgccggcagatgcaggcatggcgatcatggccgccatggcggcggcggcgacggtggaacagatcctggcaggcattggggagcacctcgcagcgggttgtcacacctgcgatggtgcccgcctatgcatgccgacgcgcgcccgatccgatcggatcgcgtgccgatccgatcaggccgagagacgtgtcggggccggggtcggagtcggggccggtaccggctcggtctggtcgcggatcgctgcggattccgtctggtcgcgaatcgctccgggcggatggccgaagcgctggcggaagcgggcggcgaagcgcgaggggctgtcatagccgaccagggccgcgacggtcgccaccggctggtcggtcacctgcagcagcatcagcgcatgggccatgcgggtctcggtgaccagatcggtgagcgaggtgccttcggccgccagcctgcggcgcagcgtcgcctcgctcatcgcaagctgcgaggcgacctctgccgcccgccagggggccgccagatcgcctgcgaccagggcgcggatccgctgcgcgatggccggcggcaccggcggcgggaaggcaccgccatgatgggcgatccagcccagcacctcgcgcatccgctgcacggccacggtttccggcaccgcggccggatcggcgactgctgcccgcgcccgctcataggcctcgaggaaatccggcgccatggccgggatggtgagggctcgggcaatcggccgcacagcgtcgggcaccgcgaagcccgcgatcacggcctgatcgatgaccaggaaatcggcggcataaaccccgttgtccggtcggttgaccacgtcgaagacctcgccgcccgcaatcgccgccgccccgccggccgggatcaccgtctccgtcccggccgcgcgcagcagcttgagaccgcggcggaccaccatcagggtcggctgatcgaccgcgatccgggtcagcagcaattcccggcgctgcagcacccgggcgatcacccccaccccgttgcgcaggatcacccggcgatccgtcagcatgtctttcacctctcaccgcgcctgcgatcgccccggggcgtgggacggggcttcccgtgcacgcccggcgcgctatgctgcgaccccgacgagatcccttgcccgggccgatgctgtccggacagtcttcccccgccggcaccggcttcgcaaggcttgcatgttcatggcgctctccatacaggcgcgcggcaccgcgcttgccaccgcaggcattctgacccttacaccagacacgcttctggtgcggttgatcgccgccgatccctggctgctgctgttctggcgcggcgggctgatggcgctgaccatcctgattgcctggtgggcggtgacccgggaaccgccctggcgggcgctcacccgcatcggccgcaccggctgggcctcgggcatggcgctggggctgggatccgtctgcttcatcctgtcgctgaactacaccgcggtcgccaacacgctggtgatcatttcctccggctcgctgttcggcgcgctgctgtcgcgcgcctttctgggcgagccggtgccgctgcgcacctgggccgccatcggtgcggccctggcgggcatcgcccttctggtcttcggcggccggatcttcggcgacgacgcggccggccagaccggcagccggctgggcgacctgatcgccctggtcgccgccctgctgatggcgatccatctggtgatcctgcgcgccagcggcggccgcatcccgtccacccccgtggtcggggtgggcgggctcacctgctgcatcaccggccttgcggtcgcactgggccttggcctgcggccgctgctgccggatgcggatgtcgtgccgctggtgctggtctacgggctggtggtgctgccggtctctttcgcgctgatctcgtccgcgccccgctacatcccggcggcagaggtcagcctgatcatgctggccgaggcggtgatcggcccgttctgggtctggctggcggtcgatgaagtgccgcccaccgccaccttcgcgggcggtgcggtggtgctgaccaccctggtcctgcacggcgtcgccggcttccgcgccgagcggcgccggcgtctggcataggggtcaaccgggactccggcgcatcaacgcggtggcgagccccgccccgatcatcagcgtgccgccggtgcggttgaccgcccgctgcacgaccggccgccggatcacccgccgcgcccgcgcggccgcgagcccgtagagcgacacattgaggatggcgaggccgatgaaggtcgcctccaggatcaccatctgcggcagcagcggcgccgtggggtcgatgaactgcggcaggaaggccacgaagaacacgatgcccttggggttgagcgcggtcaccagccaggcatgcaggaacacccggccgagccgggtttcagcgggcggcgcctcggcgaccagccccgccgcatcgacggcgaccggcgcccgccagagcttcagccccagccagaccagataggcggcgcccgcgatcttcacgatggtgaagacggtggccgaggtggcgagcagcgcccccgtgccggccatcgacgccgtcatcgcggtcagatcccccagcgccaccccgcccaccaccgcgccggcggtgcggcggccatgggacagcgcataggagatgaccagcagcacggtcggccccggcatgacgagcagcgccgccgaggcggcggcgaaggcgatccaggtttcgggcgacatgaaaaactcccctcccgatggtctcgggagaggagcaatccacggatccgcgtccgcgacaagaggcagttggtctcagtccgcgaaggcagagcccggtctcagtccgcgaaggcagagccttcgggccgcggctgggtataacccaggcgcaggttcagcttctcaagcaggtcgatcgccgcctcggcgatgaccgtgccgggcgggtagaccgcggcggcgccgccgtccagcagggcctggaagtcctggggcgggatcacgccgccgaccacgatcatcacattgtccttgccctgggcatccagttccgcccgcagttccggcacgagcgtcagatggccggcggccagagagctggcgcccacgacatgggcatcggtttcggcggcggccttggcggcctcttccggggtctggaacagcgggccgatctcgacgtcgaagcccagatccgagaaggccgtggcgatcaccttctggccgcggtcatgaccgtcctggcccatcttggcgagcataatccgcggcgcgcggccgtccagatccttgaaggcgcggatcatctcgcgcgcccgctcgaccaccgcattgccctcgcccacttccggcagatagatgccgctgttgacgcggatctgcgcggcatggcggttgaagaccttctccagcgcgaaggaaatctcgcccaccgtcgccttggcgcgggcggccgcgaccgagagttccagcaggttgccattgctgcgggcgccggcttccagcgcggccagcgccgcatcgacatcggcctggctgcgctcggccttcagccgcgcgagcttttccagctgctggcgccgcacgccctcgttgtcgaccttcagcaccggaatatcgtcgtcctgttccgggcggtagcggttgacgccgaccacgctctgccggccgctgtcgatccgggcctgggtgcgcgcggcggattcttcgatccgcagcttgggcacgccagcctcgatcgccttggtcatgccgcccagcgcctcgacctcttcgatatgggccagcgcgcgctgggccagatcataggtcagccgctcgacataatggctgccgccccaggcgtcgatcagcttcgtcaggccgctttcggtctgcaggaacagctgggtgttgcgggcgatgcgggccgagaaatcggtcggcagcgcgatcgcctcgtccagcgaattggtgtgcaggctctgggtctggccggcggccgccgccatcgcctcgacgcaggtgcgcgcgacgttgttgaacacgtcctgcgccgccagcgaccagcccgaggtctggctgtgggtgcgcagcgacagcgagcgcggatccttggggttgaaatgctgcttcacgagcttcgcccagagcaggcgcgccgcccgcatcttggccgtctccatgaagtagttcatcccgatcgcccagaagaagctgagccgcggcgcgaaccggtcgacatccatgccggcggcgacaccggcgcggatgtattcgatgccgtcggccagcgtataggccagttccagatcggccgaggcgccggcttcctgcatgtggtagccggagatcgaaatcgagttgaagcgcggcatttccttcgccgtataggcgaagatgtccgagatgatcctcatcgacggcgcgggcggatagatgtaggtgttccgcaccatgaattctttgaggatgtcgttctggaccgtgccggtcagcttgtcgtgcggcacgccctgttcttcggccgccacgatatagagcgccatcaccggcaggatcgcgccgttcatggtcatcgacacgctcatctgatcgagcgggatgccgctgaacagggtgcgcatgtcgtagatcgaatcgatcgcaacaccggccataccgacatcgcccttcacccgcggatgatcgctgtcatagccgcgatgggtggcaaggtcgaaggcgaccgacaggcccttctgaccggccgcgagattgcggcggtagaaggcgttggagtcctccgcggtcgagaagcccgcatactggcggatcgtccacggattggtggcatacatggtgggataggggccgcgcacatagggcgccacacccggatagctgccggtgaagtcgatgccggccagcgcatcgggcccgtaggccggcttcacctcgatgccttcgggcgtgacccagggctcgaccgcggccgccacatcgggggcggcggcgggggtcacggcgtcgaaatcgagggcggcgaaatcgggaagcgtacgtgccatcggatcaggcctccgtaccgacagagggggtcgccacggccacatgagcctcggcaagcagagcgagcgcatccatgccggcggccaggaagcgcgagataccggccccggtcagcgccgcctccagctcgcccggacggccggccagccagacatggacggcaccggccgccttcagcgcagcggccgcggcggacgcttcttcggcatagcgggcatccgacgagcagagcacggcaaggcgcgcaccggccggcagaccatcggtgccatcatgaatatcggcatcgataccgcccgcggccagaaggttgcgggtgaaggtcagccgggcggtatagtcggccggcgtgcccagcgtcaccagcagcgccttcgggtacgagccgtcggccgtgaggccgcgggcggcctcgcgcagccgctcgtaaggctcggccaggcgcatgggggcaagcggggtgcaggcggatgccgggccgtcggccgcgatctctggcatcggccgggcgaaggacgcggggtcgacctcgtccatgctgggcgcgacatcgcccagattggggaattccgacacgccgatcaggccggtctggcgcttcgccaccgcggcctcgatcgcggcccgggtggcggcggcacgctcctgcacgatgccggcttccagcgccgcgatcaggccgccggcctgctcgatcgcctggaaggcggcccagccggcgcgggcgaagccgtcggtcagctgctccagcgcccaggcgccggcggcggggtcggcaacccggcccagatggctttcctccatcagcaccagctgggtgttgcgggcctggcggcgggcaagcgcgcccggatggccgatcgcatcggtgaagggggcgagcacgaccacatcggcgccgcccaccgcaccggcgaagccggccgcggtcagccgcagcaggttcacccaggggtcgaccttcgaaagcatgcgtgccgacgaccgcgcctcgatccgggccggaacctccacgccggaggcggcggtgatccgcccccagatcgcccgcgccgcacgaagcttggcaagcgaggtgaaatactcaccatcgaccgcaaggcccagagtcacgcgggcgaaggcctcgtcgacgccgaaacccgcctcgaccagcgccttcacgtaaagcacggcggccgccgccatcacgcccagttcctgggcctcgccgccgccggcctcgtggaccacctggcccgaggcgcgcaggaagcgggcctccagcaggtccggtgccaggcgcttcgccagcgccgccgcccgggcgacgcgggccgcgaccgatccgggggccgtgccgctggccgcgaaggccgaaaccgggtccatgttgaaggcgagcggcgcgcggatggcgccgggctggctgcgggcgaaaccggcgagccagccggccgcctcgacatcgagcgcgccggcatcgagcccgaccggcgccaggtcgatcatcacgccatcgagcaccgtcgccagatcctcggccgagaccgcggcgatgccgtcgcggccggtcggatccaggcgcagcagcaccgaggcggcgccattctccagatcctcgagcacctgggtattggcggtggcgggatcggggtggcggatcagcgtgcgcagatcccagggccgcgccgcatcacccgtggcggggcgcggcagcatccgggcggcgatgccgtcttcgggcgtgtagagcggctcgacgctcaacccctcccgggtcttccagcgcagcttcttctcgtagggtgcgcccttcagcgtcttctcgaccagggccatccaggcatcccgcgacggcggatcgaaatccgcggccagcggggtggcgggttcgaggggattgctcgtctgcacaggtttcaccacggttttttccgatccggcatcttctggcgccttcggacgcggccccgcgggcgctgcctgcacgggtctgccgaaggcgggttcggcgtttccttatccttgcgtccggaaccgggcaatgcaccgtcgtccggacatgggtcgcaagacatataccgcaaagcggtagcagactggaaacacgaaccgcatcgcagcaacacccggcacgtcgggaaccgcgtgcgaatatgcacggcggcgcggcggagggggtcagcgcagcgtcgccagatcggctgccagcccgtccagtgccgcgcggatcagggggccgcgcagccgcgccttggttgcggcataggcggcgggcgacagacgctcggccagatcccgggccatgcgctccgcccgggcgacggtgctggcggggtcgacctcgatatcgtcgatcagattctcggccagcgccgcctcggccgagaaggcttccgcatgcagcagcgcccgcgcctccagatgccgcggcaccacgctctgcgccaccatcagcatccaggccggcagcggcatgccgatcgcagtctcgttcaattgcagccgataagggccggcggtcatgcagcgcatgtcgcaggcataggccaggatcgcgccgccggcgatggcatggccggtgagcgctgcgaccgtcggcaggcccagcccgtgcagccgcagtaccagccgcgagaactgctcgaagaaggcgatgaactccgggcccgacagccccggcaggatcttgaggttcagcccggctgaaaacatgccgtcgcgccccgccagcaccagggcgcgggcgtccgccgcctcgacctcgtccagcgccgcatccagccgggtgaaccaaccggcgtcgagcgcattggccttgccgtcgtcgaagcggacggtggcgaccccgtcccggaagctggtctccatggaatgcgtctccctccctgacacgaccgcagcctcccatatgacggcggcccccgccctgccctctgatccggggcagatgcgggggccgccatcatagcgcgtccgggtggaagtcgtcacggggacgccggccccggacgttgcatcagctgccgcggctgcgcggctggatgcccagccagccaccgccgccggtgccgccggcgccgatggtgttgccgttgccgccggtgccctcgacgctgtcggtcacgcccttcaggatcgaggtggcgcggttgaagccgtcatcggcgtgataggtgatggtcaccacctcgccgcgcgcgacctcggtcatccgcgggtcgccgatcaggaaggcggtgccgtccatcagggtcaggaaagcgccgtcggcctgatagaccacgccctgcttggtatgggtcccgtcgacatcggctgccgcggcggcaagcggcgcagcggcggcctgctctggcgtcactgcatggcgctggtcggtggcggcgccggcgatgccggcaccggcgaaggtgaaggcggcgacaaacagggggagggacttgcgcatgatcttgggtcctctgttccggggacggtgccgtcgggcaccgcatgcccctcgaaaccccgggcgcccgcacccgttcccggggtcatggttttgccccgatctcgtcgcagccccgcgcgccggccatcaaaatgccgcagccgacacgcgaacgcccgccatcccgggggcagtccgggatgacgggcgtcctcgatcggcatcagggatgccgaaaggcattaagcggctgacgggtcagctgcccttggcgcggggctgagcgcccatctggccgccgccaccggtcgccgacgagccggtggtggtcgaatcggtgccggtgccgctcaggctgtcggtcgcacccttgcgcaccgaggtggccttgttggtgccgccgtcctgattgtaggtgacggtgaccttgtcgccggccttcacgtcgctcatctgagggtcgtcgacctggaacttcgtgccgtcttccagggtcacgctgtcgccgctgacgctggcgacggtgccctgcttggtcatggtgccggcgccggcacccgtgccgcccggcgcggcagcgcccgagccggtgccaatgcccggcgtggtgcccggattggtcggattggcgttctgcgaactgccggtggttccgccggcgccggacggcgtgccggaggtgccggccgcggtggcgagcgaggcgccgccgagcatgagggcggtcacgagaacgggcagggtcttgcgcatcgggggagtctccgttggtgcttggcaactgcattgcgggccattgagccggagcaactgcgttgcgggggtctgaggcgtggcggggtgccatccgcctcttgcccccttcaacggatgggggccacgaccgttccgctccctgcccgaattattcgccaggcccctcccccatcgacgggcttggcatcgccatcctgcgcgagtatgttcacgcaatcttgataataagaatcattcgcaattgagagacgagtcccttccaacgagaaagggatcggtccgaatgaacaccacacggctgacgaacggcctcggccatgggctgctggccctctgcctcaccctgcccgccaccgccttcggccagagcgcggcacaaccggtggccgcagaacgtgaagacgacgacaggacggaaggcgcagacgcgcctgcgggcacaggcgaaagactgccgccgctgtcggtgatcgccacccgcggcacccgatcggtcgacgacatccccggcaatgtgacggtgatcgacagacaggagctggacctgcgcatggtcgaggatatcggcgaactggtccggcacctgccgggcatccaggtcgaccgccagaccagcggcaccaaccccttcggcgatcgcaccggcttcaccatccgcggcgtgtcgggcaaccgcatcctgaccctggtcgacggcagccggaccctggagcggatcaccgacaacacccgcgacgtggtcgagctgacccatatgaaacgggtggagatccagcgcggcccggcctcggcactctggggcagcgatgcgctgggcggcgtggtcgccttcgagaccatggacccggaggactatctggcggtcagcggccgcgacaccgccttccgcttcgacaccacccattcgacgctggacgacgcgaccggcggcgtcggggcggcggcgctgcgctatggcgatttcgcggcctcgctgtcgctgggccggcgtgtgggccacgagcccgagaaccgcaatgcccgcagttccaaagcggccggggcggtctgggactgctatcgcaatcccggcgccacgccctgcggccagctcgatccggccgatatccgcgcggacaatgtgctcgccaaactggtctggacacccggcagcgatcaccgcatcggcctgacgctggagcatttcgagcgcgagaccgaggtcgagcaactttacgaccacggctacgacacggccggcaatttcgtcgcgaattacgaccggacccagacgctcagccggcagcgcatcgcgctggagcacgactggacggtcgatatcggcccgatcgagaccatccgctggcagctctcgcattccccgcagaagagcaggcgcgaggggacgcgcgatcgcatcctcgcgaacggcagcagcgaaacccgctacgattatcttgaatacgaggaagcctttaccgaattcgacgcccagttcgatggtgggtttgcgaccggcccgctcagccatcgcctgacctggggcgtcgacggcgactataccgaaaccgactacgagcgcgtcgacaccacggtcaaccacaccaccggcaccaccaccgtggcccgcgcaggcgggttcaacttcgccaatgccaccacgatccgcgccgatgcctatgtccaggacgagatcgggctctggaacggaaggctgcgggtgaccccggcgctgcgcctggcgcattacgcgatcgatccccatccgaatgccgattacaagccggtggacggcgccgaaccgcgcaaggtgaccgagaccgagccgacctggaaactgggcgcggtgctggatctggacgatacctattcggtctatgcccagtatgccgaaggtttcaagatgccgaccgcccagcagctttatacctcgctgcccagcacgagcttcaacctggtgcccaatccgaacctgcgcccggaatcggtgaagaattacgaggcgggcctgcgcggacgcttccgcgacggcagtttctcggtgggcggcttctatgccgactataccgatttcatccagtccttcgtcttcctgcccaatggcgacatcacctatgacaacctgaccacggtgaaggtctggggcgtcgaagcctcgggcgaactctatctggacgatctctggagcgtgaccggtgcgctctcggcccagcacggcaagcagcaggccgcgccgggcgaggataccaccgccttcgacggcgccattccgctgggcggcacgctggggctgcattacgacgacagcgcgatggggctgcgtgccagcctctacggcaccttccagcgcggcgtgacccgcaccgccagcagcgacgcctacaagcccggcggctatggcgtgttcgatttcgccgccgcctggacgcccgcgcactggatcacgctccgcctcggcatcgacaacatcttcgacaggcgctatttcccgagttcggccacggcctatgccgcccagccctccagcacctcggtcgccaacaccaacccgatcgaggcccaggtccagccgggccgcgcgttctcgctcggcgcaacgctgaccttctgacccgatgacggtcaccgccgatcccggtcgcccaggcggccgggcacgcggcaccgcccgccgccatcgcggcgggcggctgcgttgtttcctgcgtctggccctgcccttcttcctcaggcctgcgggccgggcggcggcgctcaaattcaccctcgccttcggcctcgccatcgccgcggtctggatcggcttcgaacgcaatgcctggaaccagaccttcttcggcgcgctggagcggcgcgatgccgacgccgtgtttcgggcgacgctcgactggatctggctgctggcgctgctggtcggcgtttcggtccagcgggcctatctggaacgcatggtggagatcgaatggcggacctggctgacccgccgcctgctcgaccgctggctggggcgcggcgggctctggcggctggaaagcgccggccggatcgacaatccggaccagcgggtggcagaagatgcccggctgctgtcgtcgctgaccgtggaactgacgctgcgggtgctgctcgacgtggtcgaactcggtctctatatcggcgtgctctggtatctgtcgggcacgctcgccctgccgctgccggggggcggcagcctggatctgcctggttatatggtgatcgcagcggtgctctatgccggcatcgccaatctggtcgcccatcgtctgggccggccgctcgccgggctcgccgcccggcagcagcatcgcgaggccgatttccgcttcggccttgcgcggctgcgcgatgcggcgatagaggtcgccctgctcggcggcggccggcgcgaggccgggcttgccgccggccggttcgacgccgtgcgccggaacgcgctcgaccttgcccgccgccaccggatctatgccctgttccagaccccgttcagctacaccgtgctcaacatctcgatgttcgtaacggcacccgcctatctggccggccagctggatctgggcggcatgatgcaggcgcgcggcgccttctcgaccgtggtcgcaagcttcgcgaccctggtcttcgtctatccgaaagtcgccgagctgatggcggtgctcgggcggctggaggccttcgaacaggcgctggccgatcgcggccaccgcctctgcccgcatccggcggcgcgcgccgcggcatcggatgcgctggtgctggagggggtggcggtcacgacctccgacggacaaccgctgacccggccgatcgatctggtgctgcggccgggcgagaaagtcgcgctcaccggcgcgtcgggcacgggcaagagcctgctgctctccgccatcgccggcgcctggccgcatgtcaccggcaggatcgaccggccccggacaggctggccgccggtggtcgtgccccagcgtccctatctgcccggtctcgccctcggcgacgccctgctctacccggcagacggcgacctgccggagagccgggcggaagccgcacggctgctggaggccgtggggctcggccggctggtggccgatctggacggcccgccccgcgactgggaccggcagctttcacccggagagcgtcagcgcctggccctggtccgcgccctgctgcgccggccgcgctggctgctgatcgacgaggcgacctcggcgctggatgccgaggccgagacacgggtgctggcgctgatcgaccggatgcacccgccgccggcggtgctgatggtggcgcaccgcccggtggcgatcgccgcctgcgaccgggtggtggagttgtacccggcagcagatgttccgccggatcaggcgccggcctgatccagcgccgtcatctcttcggcggtcagcgacagatccagcgccttcaccaggctgttcagctggtcgaggctggtggcgctggcgatcggcgcggtgacgccggggctggcgatcatccaggccagcgcaacctcggccggggtcgcgccatgggcctccgcaaccccgtcgagggcggccaggatggcgaagccccgcgggttcagatatttgccgacccggctgccgcgctggctctgcgagagatcggcctccgaccggtacttgcccgagaggaagcccgaagccaggctgaaataggggatgacgcccagcccgcgggccatgcacagatccctgagcggaccttcgaagccgctgcggtcatagagattgtattccggctgcaacgtctcgtagcgggcaagcccgccggcggtggagatgtcgagcgcttccgacagctgatcggcggtgaagttcgaggcgccgatcgcccgcaccttgccggccttcaccagccggtcgaaggcttccagcgtctcgtcctggggcgtgtcggcatcgggataatgggcctgatagagatcgatatgatcggtctgcaggcggcggagcgaggcctcgacgcagcgctcgatccgcacggccttcagccccttgtcgtcgggccgcatcggggcgccgaccttggtcaggatcttgaccttcgcccgcttcgccgggttggcggccagccatctgccgatgatggtctcggactcgccaccctcatgcccatcgacccagaccgaatagacgtcggcggtgtcgatcgcatcgatgccggcatcgaccagggcatcgagcagggtgaaggaggtcggctcgtcggcggtccagccgaacacgttgccgccgaaaaccaggggcacgatttcaaggccggactggccgagctggcgcgtctgcatgggggaacctctcctgatccaggaacgcccgcagatgccgcctccccggaaaagctccggggccggctgcgggcgacccatggtcgcgcgcccccggccccgtatgcaagccgtcagcgtccccagccctcaccactcacacggatgcgcatggccccggatggcgagatgtacccccacccgccattgaggcgggggccaagggcacggagtgcccgcccggcgagggactaaaaagactcacccgcccggcgagggaccagacagactccttctcagatgcagcgcccgccatcgacttccatgcagacgccggtcaggaacgaggcggcatccgaagcgaggaaggcggtggcttcggccacgtcgcgggccgaagacaggcggccgagcggaatggtctcgatgatcttggcgcgcgcctcgggcgtgtcgggctggccgaggaaggcgctggtcaggccggtcgggcccatcaccgggttgacggcgcagacccggatgttgtcgggcgccagttccaccgccatggtcttggtgatgaccacggccgcgcccttgctgccgttgtaccagaccagacccgggcgcggacgcacggcggcggtggaggcgatgttgatcatcacgccgcccttctgggcgcggaacaccggcacggcatgcttcgcggcccagaacaggctcttgacgttgacgtcgaagaccttgtcgaaggtcgcctcgtcgacatcggtcatgggcccgcggttgtgggtatagccggcattgttcaccagcacgtccagccggccgaaggcatcggtcgccgccttgatcatgcccgcggtgccggcatcggtcgccacgtcggcatgcacatagaccgcctcggcgccggtcgccttgatctcggccgtcacccgctcgccgccggcatcgttgatgtcggcgaccacgactttggcgcccttctcggcgaacagcctggcgatgccctcgccgaaacccgaaccgccgccggtgacgatcgcaaccttgcccgtcaggctcatcttctgctcctctcctggaacgatcggccggtgccccaccggccacggcatccggcccccgtctgatggtgcgggcggggtttccggaccggcctccgatctcccgtccacctccggcgacggggcgtccactctcggaaaacgcgagcggacagcgaagacattcgcggacaatagcacgtcggacggcgctgggaagagcctgcccacgcctctgaacccaaggaaatccgccgatgcccgccttgcgcggagcgtgcggcgcaccattcccgccgcagtccctgggcacaaccattcgtttcaaattgacacagaaacttgccgcccgcacagtcgaccgcaacggccaaaagcaacggccggcagaatagggagaacacgtctgatggcgatccgcgccccgcatttccccaccgacggcgtcacctggttcaatctcgcaggcccgccgccaaccctgcaggacctgcgcggccggctggtgatcctggatttctggaccttctgctgcatcaactgcatgcatgtactgccggtgctggccgagatcgagcggcgctatcccgacaccgtggcggtgatcggcgtccacagcccgaaattcaccgccgagcgcgacccggccaaggtcgccggcgcgatcgcccgctacggcatcacccatccggtgatccacgaccccgagatgcggatgtggcgcgaatatgccatccgcgcctggcccacgctgggtttcatcggccccgacggcgcctatctgggggctgcccccggcgagccggcgctggagaagctggtggaactggtcgatcgggtgcttgaagaggcgcgcgagggcggcagccttgcgcccgccacgctcgatctggcgccggcccccgaacccgcgcggctgctgcgccacccggcgaagctcaaggaattccgctatggccgcggctctgccggctgggcgatcgccgatgccggccatcaccagatcgcgctgttcgacaatgccggcaacgagatccgccgggtgggatcgggcgagcccgggctggtcgacgggccggccgaaagcgcacgcttccagcggccgcaggggctgatcgccgccgatggcgcgatcttcgtcgccgatacctggaaccacgccgtgcgccggatcgatgtggcgagcggcgaggtcaccaccatcgccggcaccggccggcgtggcccgatcctgaaggcaccagcccccgccatcgactcggctctcgccagcccctgggatctggaatatcgcgagggtgtgctgtatgtcgccaatgccggcacccatcagctggcgcggatcgatcttgagaccggcgtgctggaaccgctggccggcaccggcgccgaggcgctggtcgacgggccggccgatcaggcggcgctggcccagccctcggcgctggcgctgaaggaagatcggctctggttcatcgatgccgaaacctccagcctgcggcggctggatcttgcgggcggcacggtctcgaccctggtcggtgacggtctgttcgagttcggcatggtcgacggaccggcacggaccgcgcgctttcagcacccgctcggcctctgcttcgacatgaacggcaacattctggtcgccgacgcctataatgatgcgatccgggtggtggatccggaaaccggcatggtctccagcctcgacgatccgccctatgactgtttcgacgatctctgccgtccgctgtcggaaccggccggggttgcggtggatgacgacggggtggtgttcgtggccgataccggcaatgaccggatcttcctgtatcacgacgtgttccggaccagccggacgtgggcggaatgacgcagacgggtgcggaatgacgcagaccgggccccgggcggatgacctgctgatccgccccgcccaccccgacgaggcggcggcgctggccgcgatcgaggatgcggcggcggcacaattcgcccggatcgggatggatctgggtgctgccgcctcggatccggccgccatcgccgcacgggtggccgagggggccgtgctggccgcaagcctggggggccggctgacgggctttgccatcgtcaccgtggtggacggcaacgctcatctcgcggaactcgacgtggcgccggatgtccagcgccggggcatcggccgccgcctgatcgaggccgtggccgatcgggcgcatgcggcgggccctcaccgcctcaccctcaccacctttcgcgacgtgccctggaacggcccctggtaccgccggctggggttcacggagcttgaacccgctgcccaggggccggcgctcaggcagatccgtttggccgaagcccggcggctcgacccgctcggaccacggatcgccatggcgagaccgctctgatccggctcagagccggccgagcagctcgtcgacgaaagcggggacgatcaggcttgccgggccgtagcgggtttcggcgaacaggctggcgccttccgacggctcaaggttcagttccagcgtatgggccatgccgcgatggcggacatcggccacgaaacccgccgccggatagaccgtgcccgaggtgccgaccgagacgaacagcccgcacccggccagcgccgcccatatccgctccatctcgaacggcatttcgccgaaccagacgatatgcggccgcatccgcccggtcgatccgcagccgccgcaggccgaggcctcgtcgagatcggccaggtgatgggcgaccgcctcacactccagacagcgcaccttggccagttcgccatgcatatggatcagattgcggctgcctgcgcgctcgtgcaggtcgtcgacattctgggtcaccaccagaaccccgcccggccaggccgcctccagacgggccagcgcctgatgcgcgggattgggctgaacggtcgccagctgggtgcgccggctgttgtagaagccctggaccagagccgggttgcgggcaaaaccttcgggcgtcgccaggtcttccaggctgtggcgccgccacaccccgtcggcatcgcggaaggtgtcgagcccgctttccttcgaaatgccggcccccgtcagcaccacgatcggcaggtcgggggtcacgtcgtccaggctcgtctcagggtcgaaacggtcgatccagcgcatcggggctcactcgcgagaagaggacgagaggaaaaaatgcggcactgcggctcaacgccgcagcacctgccggcagtcgggccggcggtcctgccagccctggcgctccagctccggcacctcctgctcatcggccgcccggccaagacacagatagccgatgaagccccagccggccggcacgtccagcagctgcaccaccggtgcgggatccaggatcgagacccagcccagccccacatcatgggcacgtgccgccagccataatgtatggatggcgagcaccgccgaataggccacggtttcgggcatggtccggcggccgagcccgtggccctgttcaggatcggtgaccgcgaagaccgcgagttgcagcggcgccttgtcgagcccttccagcttcagcgcccgataggcggcgcggcgcggatcggcctgggcggtcgccgcggcctcgttcgccttcagcacctcggcgcggatggcggcacgcaaagcgggcgtgtcgacccgcacgaagcgccagggctgggagttgccgacggagggcgcgagacaggcgagatcgagcagccggtcgatcagctcttcgggcagcggatcggtgcggaacctgcgcacatcccggcgccaccgcagcaacgtctccagcatcgcctggaagtcgggatcgaaaaccggtgccgcggtcgccattcatcagctctccgtcagtcagcgcccatcgatgatcgacccgcggcggacgcggaactgcgtgccgtcatccagcttgtgcagcccgtcttccagccggcgacgggtgccgtcggggttcatcaccgtcgcctgcatgcggaactcggtcgcgtattgcgaggggccgatcatgacggtgcggccgtcggacagcatgcggatcaccgtgttgggcggcagcggcggcggcacctcggcctcgccgggcgcagccggatctccgggaaccgccggcgtcgtcggctgcggctgaaggttgcgatccggtgggatctgggcggtggccggcgccatccaaagacaggtgatcgtcaaaagtgcagaaaagaccaggggcaggcggctcggggaggaaccgggacgggcgagcatgggtgatgcgaccattcgacagacttggggacgcggcaggatccgccggcgaccggcggatcaaccgttgatccatagcatttagatgtcggcgccgcgaatcttctgcaagctctcgatcaggggatcgtcaccatcctcgtcgctctcgtcctcctcgcccccatcctcgtcgccgtcagggggcaggccaccgccggtttcggtcaccagccgccaggccggcagcaacacccggaccgtggttccgaccccgggctcgctttccagcaccacctcgccgtcatgcaggtcgaccatcgccttgaccagcgacatgccgagcccggtgccctcgtagcggcgcgacagcgagctgtcgacctgttcgaagggctggaagacccgcgggatatcgtcctcggcaatgccgatgccggtgtcggcgacatagagttcgatcgtgccgccctcggcaccccccggcgcggccgggccgggattgcggcgcacgcccagctcgacccgtccgcccggatcggtgaacttcaccgcattggacaacaggttcagcagcacctgggtcagcttgcgctcatcggccttcagatcggcgcggcgcagttcgtcgggcagttccaccaccagatccaggccaccacgccgggcgcgctcggccaccatccggcggctgcgctccagcaggaagcggatcgggacctcgctttcctcgaccgcaagcttgccggcctcggccttggacagatccagaatgtcgttgatcagcgacagcagatgctggcccgactggcggatatccgcgacatattcttcctgcttggcgctcatcggcccgaacagccccgactggagcatttccgaaaagcccaggatcgcattcaagggcgtgcgcagctcgtggctcatattggccaggaactcggccttgctgcgcgcggccgccagcgccgcatcgcgggccaggctcatgccctcggccagttccaccagccgggcggtctgctcctccagccgctcacgcgtgtcctgcaactcgtgcaggttttcctcgagctggcgttccttgaccttgatgtcggtcgcatcgacatgcacgccgaccaccagcccgccgctcatcagccgttcgcggatctgcagccagcggccgtcgacattgcgctgctcgatgatgccgatcgggttgcggtgcttgcgcacgcgctgggcgatccaggcctcacgatcggccagacctacgtcgatccggccggaatcgatttcttcccgcagcatgtcgacgaagggcgtgcccggccgggtcaggtggtccggcacgccatagaattcgcgatagcggctgttgcagaacaccagccggtcctcggcatcgaacagaaccagcccggccgacatggcgtccagcgcctcgtcgagcacgcgatgggtgcgctcggccgcctgggtctcgcggcgctggtcggaaatgtcgatcagggtccaggcgatgcggtccagccggccgtcctgcagacgatcggccatcgcggtgatccgcagccaacgcacctccgtgccggcgccgagctgacattccaccgacagccggtcgcgggtgccgcggcgcatctcgtcgagcagccctgccagccgctcgcccaccacccccatgcgtgacaggagatcggcgaaggattcggcccggccagcccaggacaacagcgtccgggcccgcttgtccgaaacccggacccgcccgtcggcatcggtgacgaccagccccacctcggcggcttccacgtccagccccatttcggggtcggccagaaagtcctgcgggacggcggcgagtgtcgaggccatggcttcgggcaggtcgatggcgatgccgcgcagcgtggcgacaccggtcgccgacatcaccggcgcgccaagcgccacgatcaccccgccgcccatccagcgccggggcgcatcgggcagaaaggcgcggtacagcatgtcttcaaggtcgccggccagcacggccgggcaaagcctgcgggcaagatcggccagcggcagggggcgctgcggctgatcggcaagatgaccgaccggcacgtccccggccacacccggccgggcaaccagcacgaagccgcaaccgggcgccgccccgccatcaaggccggagccgcccgtcgtcgccaccatgcggacctcgtcggtccgcgccacatcgcaagccgttaccgacgctttatcgcccatgccctcgttcacaccgtctcaccccaacccaccgtggcacggcggggatccggatcacctgaccgttcgtccgcaagtgtattgtccttacggaagcgaggccacatgaaccggaatgcgcgggggtgattccgctcccgtcaggccgcccggtcgccggatgccaggcggctgatcagatagtcgagattatcgctgtcgatgccctcgacctgggtcagcacacgctcgatcagggtcgagcggcatctgatccggtctccaggccggccgtcatactgcatttcacgcgccacgtcgatggccgtcatcatcgcatgcgccagcgcgtccggaatccgggcggtctgcagcaggcgctccagccccttgcggcccggatcgtcgatcagccgctgggcattcatcagcgccaccccggccagacgcgagatgccgcggtcgaaaaagccgcgatcgccgatgcacagcgcccggaacaggatggtgggcgtcagccggcgggcggcataaagcacgtcgatcagttcgtccggatcctcggcacgggacggatcgaccaggccgatcaccgcccgctcgcggccggcgagcgccagatccagcgccaggcccgcaggcacgtcgggccgcttgaccagctgggtacgcagccggtcggatacgaccgaaaccagccgctccgacaccttcaccggcagcaccggccgggcgatgacgccggcctgaacgttctcgctggccgggaaacggtcgatggcggtcagcagggtcttttcgcccagctcggccccgggattgcccaccaccgtcgcgacggcgccttcggcaccatggcggacgatcgtgtcgcccagttccgccgagatggtcttgcggcgggccaccgcttcctgtgccgcaccggtctgggcgcggacgatctcgatcagatcctcgtcggtcagaacctccgagaattccaggatcggcgtcgccaccggtacgacgtcacgcgccagcgtgcgggcgacatcgctgggcacacccggattgtccttcagggcctcggcgagggcggagcggacccgcacctcggcatcacgcagcatcagccggaaaatatcctcggccagccggcgctcgctgtcgctgagttctccgtcggcatggacggcggcgactttgcgggcaacgtcttcgcgccgcgccgccgttggctcggacagcagcttgcggatgtcttcttcgctcaatttagccatgacgacctcccccgttccgtcgcgccgccggacgatctgccccatgcgggcgggcgatccccgggcttcggtcacggcgtgaacgcctacagcttacgcgattggccgggacagcgccacgcaggacagggttaacacgttcttcacgatgttttcgtcaagaatacccggcaaaaatacccggaaaacgggtgtgccgcccgcccctgccgccgccctgcggtgataggacgcacagtcggcccccatcgcttattctagattgacgcccgagagacagccgtgatccgccggggcaacggcgtgcgcggccgaggcgcagatacatgaggatgagacaagatcaatgaagacccctttccgcatcgcaacccctttccgcatcgcatccgtggccggcctcgccggcctgatgctcgccgcaggccccgccgccgccgagggtgacgccgccaagggcgagaagatctttgcccgctgcaaggcctgccacaccatcgaggccggcggccccaaccgcgtcggccccaatctccacggcgtctacggccgcgaggcaggcaaggccgagggcttcaagtattcgaatgccatggccgagtccggcgtggtctggacccctgaaaacctcgacacctacctgacggccccggcaaagttcatcaagggtaaccgcatggccttcgccgggcttgcaaagccggaagaacgcgccgacatcatcgcctatctcgccagccagaaatgagccggggcgcccccttgcggtcaccggcccggaaggatcattgaccgacagcgccggacctgacgtcttcaccgccgccgccctggcccgacatctgggccgggtgatcgccgcccccaccaccgccgatgccggggcgcatgccgccctggaagcggcggtgacggcggcgcgcggctgcacgctctgtgcgccgcatctgccacgcggcccccgcccggtgcttcgcgccggggcgagcgcccgcattctgatcgtcgggcaggcgccgggaaccagggttcacgagaccggcctgccctggaacgatgccagcggcgaccggctgcgcgactggaccgggctcgaccgcgaggtcttttacgatccggcccgcatcgcgatcatccccatgggcttctgctatccgggccgcggcgccggcggcgacctgccgccccggccggaatgcgccccggcctggcatccgcggctgctgccgcatctgcccgaactgcgcctggtgatcctggccggtgcctatgcgatcggggcctatgcccggccgctgctcggccctgctttcgcacgtgcaccactctcggacgtggtcgcagcctgggaaaccctgcccccgggcatcatgcccctgccccatccctccccccgcaaccgacgctggctgcgcgaccggccctggttcgaagaccgtgtggtgccggcgctgaagcagcgggtggattatgcgctcgggcgatgacgcagcgcagtctttcgtgtcgcactgcaagaaaaacctgaggcacgacgtcgccacagatcggccttttccatttatttcaagaccatgcatgcaggcctcttgtaccgtttctgtcgcacggcgcctgaaactgcgttaggatttcacccagagagagacgatcgccggcatgaccggcgccacgtctccgatcctggggaggacctacacgatggtggccatgcatgtgcgggaccatatcgaggaagtcgtgcgtgtcgtctcgaccgagacgcctgaacccggcactgcggcgcgcgcccgtcggggccttgcccggccgcagcagctgcgcgcctcccccttccgcgacgcacagcagggccacaccccgctgcgcgacgggttgatccgcgacagctggcggcgctgtgtcgcgacccacggcctggaccccacccgcctgcaggaggcccgcatcctgcccgaggcgcgggtgcgcgagcatcgcgaacggctggaagacctgatccgcaccgcccgcttcggcctggaaagcctgcatcgccgcatcgccggccagggctatgtactgctgctgtcggatgcgcgcggcgtgacggtcgatttcatgggcgaccccaccttcgacaatcatctgcgccgggcaggcctctatctgggctcggactggaacgaggcccatgccggcacctgtggcgtggggctgtgcatcgcctctggcgaggcgctgaccgtgcatcagaccgaccatttcgatgccacccatgtcgggctgacctgcacctgtgcgccgatccacgatgtcgacggccgtctcgccgccgtgctcgacatctcggccctgcgctcccccacacctaaggacagccagcatctggccctgcagctggtgcaggactacgcccataccatcgaaatggccaatctggagcggcgcttccgcgaccgctggctggtccgcttcagcctgtcgccggatttcgtagaggccgacccggattgtgcggtcgcgctggacgacgacggccgcatcctgggcatgaccgatcgggcccgccgtctgctcgccggtcaggccgatggcagcgctcgcgacccgtcggcggtgatcggccggcatttcaacgagctggtggatttcgacgtcgaacgcctgggcgatctgggccggggagctgcaaccgagtcctgcggcatcgaggtccgctcgggccgcatgctctatgcccatgccgccccgccgggcccggcccccgccgcccgcagccgccccgatgcgctccgccgcggcacccatggcctgccggcaccgctcgccgcccttaccggcggcgaccctgccatcctggccatgctgggccgcgccgcccggctggtcgaggcgccggtcgcgatcatgatccgcggcgagaccggcacggggaaggaatatctcgccaaggccctgcaccagtcgcgccgcaaacccggccccttcgtggcggtcaactgcgcagccctgcccgaaagcctgatcgaaagcgagctgttcggccatgtccccggcgccttcaccggcgcccgcgcccgcggccatgccgggctgatccgcgaggcatcgggcggcacgctgttcctggacgaaatcggcgacatgccgctcgcccttcaggggcggctgctcagggtgctggccgaacgcgaggtgctgcctgtcggcggctcgcggccggtgccggtcgacatccgggtgatctcggccagccatcgcgacctgatggccgaggtgcgcgccggccgcttccgcgaagatctgtactaccgcctgaacggcgccctgctgaccctgccgccgctcagggaacgcgccgatctggactggctggtcggccggatgctggccgacggcgcggccgatcccgccggccaccgcctggacccgcaggcccggctgcgcctgcgcgcccatcactggccgggcaatctgcgggaactggccaatgcgctggtctgcgcccgggcggtctccaccggcggcgtgatccgggtcaccgacctgcccgaagacctgcaggccccggcactcagcgcccaggcccatgccatcggcccccatccgcgggcgcgggaggatgccgagatgctgcgcatggtgctgaaatcccaccgctggaacgtctcggccgccgcccgcgcgctcggcatcgaccgcaccaccgtccaccgccgcatgcgccgcctgggcatccgcccgccgcatcgggtagaggggtgaggcgcggcaggccataggctcctgaacgccacgatcagcgacagtacaggtggattcccgcctccgcgggaatgaggttatctttttgttctaacacaataaactgtcatccccgcgaaggcggggatccacctttgcgtcacgatgcacgacatcggcaggaggcagatccgatctgcgcccgccgacctgcggcacccgcatcgcccgtggcgccacagctgtggcagggcgcacgcgacacgccacagcggctttcgtccaagcatttgattctgctcaaaacatagaactggcccgccttttgccactctcagcccggaccgcaccgtcagatgtgcggcgacaagatggatgaggggcatggaaacgcgacgagacgacgcagcgccgcctgcgggcgcgccgctggtgggcgtgatcgccaatccggtctccgcgcgggatatccgccgggtgatcgccaacgccaccagcctgcagatcgccgaccgggccaatatcgtgctccggattctggcctgtctgcgccatttcggcatcggccgggtggtgatgatgccggatactggcggggtgcggtcgcatgtgaagcgcggcctgcaccaatcggccaatcgcggtgacggccgcttcccggcggtcgaatggctggacatggccgtcaccgccaccgccgacgacagcatcgaggccgcccggcgcatggccgccatgggtgtggcggtgatcgtggttctgggtggcgacggcacccatcgcgccgttgcctcggcctgcggccgcgtaccgatcgccggtgtgtcgaccggcaccaacaacgcctttcccgacacccgcgaggccaccgtcaccgggctggccgtggggctggccgccgccgggctggtaccggccgaggtggccttccgccccaacaagcgtctggaggtgaccgtcgccggccgcaccgaaaccgcgctggtcgatgtggcggtggtggcggagcgctatgtcggcgcccgcgcgctctggcgcaccgagggtttccgcgagcttttcgtcaccttcggcgacccgcgcaccatcggcatgtcggccatcgccgggctgtcggctccggtcgaccgcgaggcccccttcggccgccatctgcgcttcgccgaccctgcccatgcggaacgggtgctgcatgccccgatcgcccccgggctgatcctgccggtcggcatcgatgccatcgcccggctggatcccgaccggccggtgcgggtgatggccgaggccgggtctctcgccttcgacggcgagcgcgaaatcgccttcaccgcagcggacgcccccaccgtcacgctgcgcaccgatgccttccgcaccgtcgatgtcgaggcctgcatggcccatgccgcggcggaaggcctgttcttcgacaggatgcgggcaccggctgcaaacaccagcgcctgacgacatccccgcacctgaccactcctacgactcaaccacgaaggcggacacaccgccaccatccagggaggatgaccgatgccggattcaaagcccgcccgtcccgacgggccgctgccgctcgatcacgaccggctgctccacgcctaccggatcatgcgcaccatccgcgatttcgaggaacgcctgcatgtcgatttcggccgcggcgacatccccggcttcgtgcatctctatgccggcgaagaggcgacggccgccggcatcatgatgcatctgaacgatcaggaccgcatcgcctccacccatcgcggccatggccattgcatcgccaagggcgtcgacgtggtgggcatgatggccgagatctacggcaagaccaccggctcctgccgcggcaagggcggctccatgcacatcgccgacctgtccaagggcatgatgggcgccaacggcatcctcggcgccggtgcgccgctggtctgcggcgcggcgctggccgccaaggtgctgggccacaagggtgtcggcatcagcttcgtcggcgacggcgcctccaaccagggcaccttccttgaaagcctgaacctggccgccgtctggaacctgccggcgatcttcgtggtcgagaacaacggctatgccgaaagcaccgccttcgaatgggcggtcgcggccgacagctatgtcgaccgtgcgaccggcttcggcctgcccggcgtcaccgtcgacggcaccgatttcttcgcggtctacgaggcggcgggcgaggtgatcgcccgggcgcgcgagggcggcgggccgtcgctgctggaatgcaagatggtccgcttcttcggccatttcgaaggcgatgcccagacctaccgcgccaagggcgagctggagcgcatccgcgccgagcaggactgcatccggatcttccgcagccgcgtcaccggtgcgggcgtggtgaccgatgccgaatgcgacgcgatcgatgccgaggtggcagagctgatcgagcgcgccgtgcaggccgccaaggacgcgccgatgccgtccccggcggatctcctcaccgacgtctacgtctcgtactgagccggtccggctcttcttccggaggatttccgtcatggcccgcaagatcagcatgaaagacgccatcaacgaggcgctggaccaggagatgacccgcgaccccaccgtcatcatgatgggtgaggacatcgtgggcggcaccggtgccagcggcgaggccgatgcctggggcggcgttctgggcgtcaccaaggggctctacgccaagcatggcgaccggctgatggacacgccgctgtctgaaagtgcctatgtcggtgccgcaatcggcgccgccacctgtggcctgcgccccgtcgcggagctgatgttcatcgacttcatgggcgtgtgcttcgaccagatctacaaccaggccgccaagttccgctacatgttcggcggcaaggccgaaacgccggtcaccatccgcgccatggtcggcggcggcttccgggcggcggcacagcacagccagatgctgaccccgctgttcacccacatccccgggctcaaggtcgtctgcccgtcgaacgcctatgacgccaagggcctgctgatccagtcgatccgcgacaacgacccggtgatcttctgcgagcataaggcgctctacggccacgaaaccgatgtccctgccgaatcctacgccatccccttcgccgaggcggcggtggtgcgcgagggcggcgacgtcaccatcgtgacctatgggctgatggtgcaccgggccctggaagccgccgccctgctggcgaaagacgggatcgaggccgagatcatcgacctgcgcacgctctcgccgctcgacatggacaccgttctggaaagcgtggaggcgaccggccggctggtggtggtcgacgaggcgcatccccggtgctcgatcgcaaccgacatcgccgcccgggtgacgcaggacgccttcaaggcgctgaaggccgcgccgcgcatggtgaccgcaccccataccccggtgccgttctcgcccacgctcgaagacctgttcctgccctcgggccaggcgatcgccgaggccgcccgcacgaccctcggccgctgaccaggagacgaaaccgcgatgagtgacgaccgcatcaagccgctggtcatgccgaaatggggcctgtccatgcaggagggccgccttgccgcctggctggtcgaggaaggggccgacatctcggtcggcgacgagatcatggaggtcgagaccgacaagatcaccaatgtcgtggaggcggccgatgccggccgtctccgccgccgggtcgggcaggagggcgaggtctacccggtgaaggcgctgctgggcgtgctggcgccgcccgaggtggacgacgccgcgatcgatgccttcgtcgccgcctatgaggtgccggcggcgggcggcgatgacgaggacgccacccctgcccatgccttcgtcgacaccccggccggccggctgcgccatgccagccgcggcgagggcggcccccatgtcgtgctgatccacggcttcggcggcgatctcgacaactggctgttcaacatcgacgatctggccgccgctgcccgggtccatgccctcgacctgccgggccatggccagtcgtccaaggatgtgggcgcgggtgatctggatgcgctgaccgacgcggtgcttgccttcatggacagccaggatatcgaggcggcgcatctggtcggtcattccatgggcggtgcggtctcggcgcgcctcgccacgacaaggccggagcgcgcccgctccctgacgctgatcgcctcggctgggctgggggacgacatcgaccagggctatatcgacggcttcgtcaccgcggcctcgcgccgcgacctcaaacccgtgctctcgaaactcttcgccgaccaggccctggtcgggcggcggctggtcgacgatctgctgaaatacaaacgcctcgacggggtcgatgcggcactggcgaagctccgcgacgggctgttcgcgggcggccgccagaagaccccgctcgccggtgccatcgccgctgccgatctgccggtgctggtgatctggggcacggaggaccgggtgatcccggccgcccatgccactgccgtgcccggggccacggtcgaggtcctgcccgatgccggccacatggtccagatggaagcggctgcccgggtcaacgaattgatccggcgccatatcggaggatgatcccatgaccgcctctctccccctttccggtcgccgcacggtggtgaccggcgccggccgcggcatcggtgccgccatcgcccgcgggcttgccgcccagggtgcggcggtgatgatcgccgatctcaaccccgacaccgccgccggcgtggctgacgagatccgcaaggccggcggcaaggccgcctccaccgcggtcgacgtgcgcgagcgggcctcggtcgcggccatgctcgaccggacgatcgctgaattcggcggactggacgtggtgttcaacaatgccggcatcgcccaggtccgccccttcctcgccatcaccgaagacgactggcggacggtgatggacgtgaacgggctgggcgtgctgatcggcatgcaggaagcgatcacccgcctgcgcgcgcagggcacgggcggtgcgatcatcaacaccgcctccatcgccggcaagcagggctacgagccgctggcccattattccgccagcaaattcgcggtcgtcgccctgacccaggcggcggcgcgggccttcggggcggagaatatccgggtgaatgcgatctgcccgggcgtggtcgcgaccgatatgtggaagctgatcgatcagggcttccgcgactcaggcctcaccggccgcgagaacgaggccttcgatcaattcgccgccggcgccgtgctcggccgtccctccagggccgaggatctggtcggcgtcgcctgtttcctggcatccgatgcggccgccttcatgaccggccagaccctgctggtcgacggcgggatggtgatggactgacctcccgggtccacaccctcttccccaccgccgtctccaccccgccccggctccacccggggcggggttttcctgtgcggccgcctgcacggcctgtttcccgccgcacaacgcgacgctgatgttgcgcttccgtgacgtcaggtgacgatacggcaaccttcaggagcgcgcgcagtcgccgtggaacaaggcgcgcctttgcggccggaacactcactcgcttctgcatctgttgccgtgccgacgcatgaccggaggcgtccgccacacatcaggctccggaacagataaaccggattgactgccctccaccgcccacgcaaattgatgccgtgtggtttcagttttcccaaaatggggggatcttcgcatgacgcagtccgtgtcgtccgatcagaatgccggcggagacgtcaagacggcaaaggccgcctgggtccgtccgactctcgatgcgatggatctggtcaccacgaccagggtggccgggggcttcggccccgacaatgacctgtcccccagctgaagccgacgtctttcaggccggctcacgaaaacagccctgaggcgatggtgtgagccgcgcctccacccgatcggatgatcccggctgatcgggatctgcgcgggctctggcatccgacctgcgcacggagtgccgatgataccgtccctggatgcccttctggctccgcacgacccggcgctgctccatgcggccatccgggaacgccgcatggcctggttccggaccggccatgatgatctgttccgcgcgcttctgccctggtcgaccttcaacagcctgctggggtcggagcggctgctggacgaccggacccggatggtgcggcgtggccgcgacctgccgcgggaaatgtggagctatctcggccccgacatgaagcgggtggtcgtgcccgagctgttgcagcggttctgccatgaggggctgagcatcgccctcaaccagatccagcatgcggttcccggcatcgccgccctggtcaagatgctggaacaggcgctgccggcccgcatcgggaccaatgtctatgccagcttcggcagggaaagcgcgttccgcgcccatcacgacccccatgacgtgctggtcctgcatctgcacggccgcaagcggtggttcgggttcgggcatcaaagcgcacacccgcccggcatgccgctcaccaacgaccgcctcggccccgtgcattgggaacaggtgctggagcctggcgacattctgtatctcccgcgcggcgagatccaccgggcgtcggtcgagggggaggcatccctccatctgaccaacgcgctgctctggccccggggatcggacctgctgcactggctggccgggaccgggttggccgggaatgggttggcggccgacgatctcgaccgggacatcccggtctacgggacggccaccgatctggaacgctgcgcagaagagctgcgcgccacgctgcaccgcctggccgatagcatcgatctcaccgccttcctggccgcccacatacagaagcgacagacccggccgcccttcaatctgggcctgtcgtcagattgcgcgccgacctgctgggttcagcccctgccggcaccggatctgcgcctgccggcggagggcggtgccaccatcccgttcaacggcgaagaggtgacgctggatccggatgagcgtgccgtgctggcggcattgctggccggcggcgcacggcagatcgccagcctgcccggtccggccgggctggacatggagacggtgcgtgacaccgtcgcccgccttgcccgacggtctctcgtcctgctgacggaaggctgatctcacgcctggccggcctgcagacgcagatgctccaggcggtcatgatgcgcgtccgccagatcacgggcaagcgctgccagatccgcggtcaccgccgcgcgtttacgggtgccgtcgggctcgaacctctgccggcccgtcggatccttggcatggcggccggccgcatgggccagacgatcggcttcctccgcggtcggtatcagccccagccagggcaggatctgcgtcgtcagggcctggggcagcgcttcatagggcaccagcagccagtcccctgccccctgccgctccacatcgcgcaccacccccgccaggatccgccccagcacctgggcggcgaaggccaggggcgtgtctgcaacctgcgacggcgtgccccccagaaagagcccggcctgcatccgatgcgcggcccgccgcatccatccggccgggcggtcccgcagagagaccaggatctcgtcgggccggcggtagacgaacagcttcggcacgccgggaaaggcctgatccagcaaaggcaggtgcagggcgttccagctggacagtttcaggatgaaccggtcctgatccggccgggcgatccgggccagggcggcagccacccgccgcagggcctccacctttgtcgcagccggcaggaacggccagacgccatcgacgctcaacacgtcgttgagcgcctggggctccgagaccacatggcagcgggtgagcagcgacaggctgcgcgaaaccagggtggagccgcagcggccggtatgcaggatcagcgccgcgggggccggcgcatcacccgtcaacggcagttcagcccgccagcccggccctgcccctgcaatcctgtcatcgaagaagggcaagcccgggtccgtgccggcgatatcggcccagtcggccgtgatccggccggcctcgtgatgaagcctggccggcacgggttgcggcacggctgagaggaccggctccatcggtcagccgtggatgcggatcagcttctgatcttccatctgccccagcagatccagaacgtcgcgctcgatctcggcagcggatgcgtcataccgctcccccagcgaccggcagagatcggtcaccttccgcggccgctccagctcccgccagatctcggcgctgatgcggttcaggctgaaataccgcccctgttccatatccatcatgatcagttcgccatcggtttcggtggcaagcagatcggggttggccgaaacgacgctggaaagctcgatcatgatccggttaccctgttcgacatccgggggagagggatggtatcagcatccggcggattcgtcggcgggttttcggcagatcgtcggcaggggcgcgatgtgcaaagacccgttcaccatccttcccatgtcatcgcccttcccacgccgacggacgcctcatgacacccgccgccatcgacgcattctcggccgtcccgccacatctcgtcatccgcgatgcgttcggggcagacatggccgcccgcctgctcgcctttgccctggcgcaggcggagctgttctccgaaacccaggtgggcaatcagaagggccgggttgcgaagcagatccgcagttcacgggtcatcggaaccctcggtgcgctcgaaggcgatctggagacgaagttccgcgccctgctgccccgggcgacagccgccttgcatctggcgcccttcactctcgacagtctgtcgatggagcttgccgcccatggcgatggcgacttctaccggcggcacatcgacactttcgtgcggggggagatgaccggcaccgaccgggtgctgaccgccgtctactattttcatgccacgcccaaaccttttacggggggagaattgcggctgcattcccttcgcccgctcgaccagggcggcagttacatcgacatcgaaccggtgcatgacagcctgctgctgtttccggcctgggcaccacacgaagtgcgcccggtctcctgcccggggggcagcttcgctcagtcacgctttgccatcaattgctggtacaacagccgggcgcactgatacgggttgcgaccgtcagccctcgcccgcagccgttacgatcagcaggccttccccctccagccgtgtcaggaaatgcgccgcctcggcccggatggtctcttccggtgcatcgtagatcggcgcgagttcggccacgatccgatcgaggctgcagggtgtcgccagaagctgccagatgcggccggccaccggattgagattgaagtaccggccgagttcaacgctcatcatgatgacctgatcgccgaccgatgcgctcaacaggcgggtcttctgccgatagagccgatccgtcgtcacggcggcgatagtcacatcgtcctgcatggtcgtcacgctcccggagcccgcacctcgttgatcaccacggtttcagtgtagcgccggacgggtctggctcgaagcctgatattcaaaaggccaggcatctgaaagcgctgcaatgtgaaacgtatgcacgccatatcattgaattgcctggcttgtttatacacactttcaagcatctcccggcatacggccggattcctgttctgacgatctatgacatctgctacactgaaaatgtcagatttcgagataatgtaacgacatagactcgcaaagctgcactgctcgcagatctcgatcttttcaagcaggacgatgacatgactgataccaggcatgatcttaccccggacgtggcaccgacagcgccccgcctgaaatggcagacacccgattttgaggtgctgcagaccgcccagaccagcaacaacggcctcgtcgcccccggcgatgacatcttttcgccgtctccgaccggaagctgatccggccgtcgatgtcgttttttgcagggctcgtcggcacggaacccgtcccggccgagggcagcgacgggcttgacggcattgccgcaacctatggcgggggcggcagggcatcggtctggcgtggcgattcggcggcgatggtgcatgtgccgcgccccgtcacgcccgaggatcgtctggaccgctttcccgccgcgtttgccgggggcacctccaggctggtcttcgacggccggctggacaatcgtgaggacgtgatccgggcgctggcgctggatccggcccgtgccgttcgccttggcgatggtgcgttggtgatggcggcgctggagcgctgggggatcgacgcctgcccccgactgatcggtgccttcgccttcgcctggtggaacgagagcctgcgccgcctggtgatggcggcagatgccagcggcggccggacgatctttgcacacagtgacggccggcggctccgcttcgccagccggcccctggcggttctggcctttccaggcatggcccgccaggtcgacgaaaccgcgatggcgcatctcctgctcgcacgtcccattccggcaggggcgaccccctttcgcggcgtgttccgcctgccgccggccgggctgctggtctggaaggacggccaccacagcatcagccgctactggcgccccgatcccggccgcaggatcgtatatcgggatccacgcgactatgtcgaggcagcgcgcgaactgctcgaccaggtcgtcgcggccaatctgagggcgatcgaccccgtcgcctgccagctgtcgggggggctggattccagcgcggtggctgcgacggccgcccggttgagcagcccgcgggtgctgcacacgctcaccgcgcagccggatcccagcgccccgatgccggccgaacgcccccgcggcttctacgacgaggggccctttgccgcggctaccgcggcgctctatccgaacatcaccccacattatcttcccgccggggcaatcacgccgggggaagaggatgcgacggccctgttccggcagttcggcgtgccgatgcggaacttcaccaattttggcgcctggcagcccctctatgcccgggcgaaagcgctcggcgcatcggtgatcctgaccgggacggcgggcaattgcaccctgtcgtggaagagcgaggccctgctcgccgatctcgccgccgcgggacggttcgtggaactggcgcgacagcttcacggtctgcgccgccatggccatcgtccctggcctcagatccggcagaatctgttgcgatatgtggttcccgcccgcgctcggaggcagatgcagcggctgcgcggcaccggggaagcctggcgcaagcgtgcactgctgaccgccgatctggaggcgctggtcgagccggtcgcggtcaccgactcagtgctcatcagtaccgaccgcgccgactatgatcgccggtcccgcatcgcctatctcgacagatacttcgcgaactgccagtggctggcggggcatccctacgtcaccggttgcgatccgcgcgaccccctgggcgatcggcggctggtcgagttctgtctggctcttccggtgacgatctggcagacgaatggtaaacctcgttccttcgcccgcgaggtcctgaaggatcgtctgccgccccgggtggtggacaatcagaagcgcggctatcagaacggcgactggttccaccggctgacacagctccgccctgctttcatggccgaactcgaccggctggaggcatcggccagcgtccggaggatggtgaacctgcagcgcatccgcgccgtggccgaaaactggccggcagatgccgatgccgccatggcccgcgacgccgagatgctcgacctttttgcccgtggcatccattacagccgcttcatccgctgggtcgagggatccaacgcgtgagcgacatggcgggccgcccggcttacagatagcccagccggtacatcacctcgccgtgatcgcgctcgatctgctcgacctgcgccgggttcagtgtgtcacgccagccgcccgccattccccggcggaagaaacgccggccgccaccgggcgtttccgggaagttgccggccttctcctcgtcccgcaggcggtcgaaacgcgtcgccgccacggtccccgcgatcgcggcttcgctgctggtccagccaagggtggcgctcgtctgccgcagaaccgcggcgaaatccgcaagcatgtcctcatagcggatcaccagaggggcgagccccgagcgatcgatccagctcgtgacatgtccgctccagtccgaatacgtctgcggcaggtgatgatgccccgagcggatgccagccgccacggcgtagtccggatctgccatcagagcgatggcctcatcaacctccatgccgaaatgatgggcgaacgagaccgccacatcgcgcggatcccgcaccagatagatggatgcagccgtcacctcttccggaaacagcgcctcgccatccgacgtgcgctgccaacagtcatggatcttccagatcgtcgtctcccgggcctgggtgtccatgaagccgtagaccttgggccgcagcagcagcacttcttctgccgacagatcagaggagtcgatatcgagcgccatgtcgaagcgatggcgtgcggcgagcaggatgccgatattattgaccatgctgccgagatcgatgggcttgccgccattctgcagcgtaatcagggcgatccgcatccaggtattgcccgatttgggataggaggccagccacacattgtcccggacccggttcggtatcatcacgcagcctccgtcagcagccggccgatctgcggtccgacccgggctatggtgccgagcccgtcgggcagggtcagcgcgtggttcggcagggtcgtggcaagggtcgcacaggcctgaaacacccggtcggagaggcccagaagatcggcggccgtgcgccggtagatacagtcatgcagcacccgaaccgccggcagcccgctctgcggaaccagcctgggcccatccggcaattgccggatccgcggatgcaagcggcagatggcgtcgagacgtctcggcaccccatcgaaactccgaaagaccgggcggtcgaacttctccagaaccacaaggcgacgcaaccgtcttccgggagcgatgccgagggcgtcgagcgtgtcgcgccagagcttctgacgcgggacaccgggcagaaccgccggcccacccggggcacacatatcgatcatggtgacgtcgtcggacagaagctcagccccctcggccagaagcagggccgctacggtcgactttcccgtagccgacggccccatgagcgcgacggttcgaccgccgatcaccaccgtgctcgcctgcagcggaaacagaccccgttgaagccccaggaaccccagcaccgggcccagcagaaagacggcaatatcgggcgtgtcgtcggcatgggggctgtcgatgatcacctcgccgccgccactcaccaggaaatccgccacgttcctgaccgtatagcgcagctgtccgcgttcattcacctgcaccagaggggtctgccgtacccgtccggaaagctcttgcggcacctcgccccgccggatatggacatccaccggcctgtcgtctcccgtccatggcagaagttcgggcaagggccagtccgtccggacccgccagccgcacagagagagatcatcacaatcggctgtcaagaatcggcacccgcaggagtaggactgacggggcaatcccccatgtgccgccacaatagcaaatccgggtcaggcagaaaccgacgcaatgcccgccgcgacgatatccgcctcgctcatgccccgccgccagtgggagaaggcgatcatgcggtcggcggagataccgacctccgtcttcaggaagccgcgcatcgcgcggaacgcactgtattcggcaccgatccaggcgaagatgtcgccgtgatcggccggcaccgccacctgccgcagggcatcgatcagcaggcttgttgtccccggcgccgcggcaccgcgacgcagccagcggatctgcacccccggcggggcggcgatcacctgttcctcggcagcgtcggcaacctcgatcagcgccacgccccccgcttccgccggcagatcttccaggatacgggcgatgccgggcaggccggtctcgtcaccggcgagcagataccaacccgccggcttcggcccgttggcggccggccccagaatgccgacgacatcgcccggcgccgcatcccgtgcccaggcggccccggggccggcaccgtcatggagcacgaaatcaatgtcgagccggccggccgcggcatcgatccggcggatggtgaagatgcgcgagggcagcacgtcgttccccggccagaggatgcggccgtgatcatcgagttcgggccagcgcggggtggtgacgcccttcgcctggaacagcagccggcaatggatctggtcgggcaccgcatagcggcccagatcctggcccgcaaaggtgatccggcgcatgcgcggcgtcagctgcgtaacgctgtggacggtgagcacgcgcagatcctgtggcagggccgagccgacggcatcgccggtccagccgatctgaagatgctcgggccgggcgacgaaatcgatcagcccggtcaggtcgtgcttgaggcggttgaaggccgccgggtcggatgcctcgaccgccagccggagcacaccctgccccggcatcagccgggcccggccgaaatcggtctcgaccagatgaccgtccccctcggcacggagcgtcatattatgggccgagagcgaggcgatgatggtgtcgagatagcggtcgagattggcaaaggcgatctcggcctcggccttgaagcgtggcatggggctcgtccttcagactgtcttgttttttcgagcgggtctcagcccgcaaggctcacccagcaggggccgggcagcggttcggcaaggaagcggcggccgatctcgtcgagcgtcgccgcagggtcgagatcggcgaacagcgccggatgcagccaggtggcggcaatctcgacgaacagaatgttgagcggggtcacgctcagcagccccgtccacaccccgtgcacccgcccgtcacggacggccggcagcgtctcgaagccggtgcgcgcgaccagccgggcaaggccggcgcgtgcggccgcagggtcgagccccggggcgatgcccggccggatgccggcgccataggaaccccccgaggcgatatagaccgccggcgcctcggtcatcagctgttcgatcggcagtttgacgtaccaggacgcctcgatcgccgagagcgtgctgccaccggcaagcctgaggagatcgccccagatccgctgccccgccgcccagcagcaatcgtcataggtcgactgaacctccagataggcgcgggtcggcgccacgccggcgagccgcccggtcacccgcgccaggcggtcggcgacgaaatccgtgaaggtgcgggcgcgggcgggcacacccagcacctcgccccacatccgcatcgcccggcccatgtcgccgatcgggtcgccggccgcacctgccggcggtgccgcattgctggcggcattgctgaacaccaccggaatgccggcggcggccagctgccggaccagacgtccctcccccagttccggttccatataggcgctggcgaccaccagatcgggggtgagcgacaggatatgctcaaccgataatgtgtcgggggtctggccgccgacctcggcgatcaggctgccatcgggccgcgtttcataacgccggcgcagaaggtcgctgtcgagcctggccacatccgcccagccgaccaccagccgcgacggatcgggatgcagcagggccatgctgatcacgtcgcgcgcatccagcagcacgatgcgcgccaccggccccgccagttcgaccgtccggccgatcacgtcggtgacgaccatcccgccgccggcggcacgggcgagcgtcggggctgcggcagccgcccccagcagggtcagaaaactgcggcgatcgagatccatcagagactggctcctcaccagctgtagcgcagcccggccagcacctcggtgccgttgccgtactggcagtaaaagccgctggtgcagctcgtgtaataggtcttgtcgaacaggttggtggcattcagcgtcacctgggtgccctgcagcgacggcgacagccgggccagatcatagcgcagcgccacatcgaccagggcgaagccgtcggccttgaagctgttggtgtcgtcggcatagctgctgccgaccacacgcacgcccgcccccagggtcagaccgtcgagcgcgccggcatcgacggcgtaattggcccagaccgacccgtgataggccggcaccgcctgcggacgcttgccgatattggccgcgaccgtcgatttcgtgacctcggtgtcgagcagggtgagggccgcaatcacctccagattggtggtgacattgccgcgggcctcgaactcgacaccccgcgagcggacttcaccctgctggacattgaaaccgggcgtgctgccgggggtgagaacgttctcctgccggatctggaaggcggagacggtgaacagcgccgtcatgaaatccggttcgtatttgacgcccagctcccactgctcggcctcggtcggatcgaagggccgccccgacgcgccgacgccgatcaccggctcgaacgaggtcgaatagctgacatagggcgcgatgccgttgtcgaaacgatagagcagaccggcacgatagctgggcgaccggctcgactggtcgctggtggtgccggccaggcggttccggctctcctgctccgtccagtcgtaacgcgcgcccagcagcagccgccaaccgcccaggctcatctggtcctgcagataaacgcccgtctgctccagggtctggcgggtatcgatcaccgccgcgagtgcccccaccggcaggccatagcgcggattgcccagatccagcggctcggccgcccccatctcataggtccagtcgctcgccgcatgctgatagtcgacgccgatgatcgcctgatgccccacggcacccgtggcgaaatcgacctgcgcccggttgtcggtggcgacaccttcaaccgtttctgtcgagcgcagagccatgcgcggcaaaaacccgtctgccgtgatcccgcccgccatctgcaggctctggaaatccaggtcgatttcggaatagcgggtcttcgagctgacgctcaccatgtcattgatccggtggtcgaagctgtagccgatggcgcgctgggtgcggtcatagctgtcgaaagccggatcgccgacattgtcctcgcggccgagcccccccttccaggcatccggcgccagctcctgcggataggtggagttgaaatagccgcccttcggatcggcctgataaaagccctgaagggtaagctgcgtgtccgcatccggctgccagcgcagctggggcgcgatcgacagccgttcctcctcgacatcgtcatagcgggtgtcggcccgccggcccatggcggcgatgccgtattgccactgcccctcggcatcgatccggccctggctggcgatgccgccctgcaaccggccatggctgccgccctcgatccgggcctcgcccgatgccgtggcagaggggctgcggctcagctgattgaccagcccgcccgggctggtctggccatagagcaccgccgacggccctttgagcacatcgatccggtcaagcaggaaaggatcgaccgagggcagcgcgaaggcctgaccgcggggcaggcgcaacccgtcgaggaagtcgacgatccgcgtcgaggtgccgaagccgccgaagccgcgcaggaacaggctgtcgtaacggccggtggcatcgggtgtggagagcacgccggcggtataggtcagcgcatccttgaccgtgcgcgcattctgatcgtccagctgaccacgggtgacggtgctgaccgattgcggggtctccagcaccggcgtcccggtcttggtcgcactggttgcgaccggcgccagataagtatcgcccgtggtcaccgccgatgcctcgccctcgacctgaagcgagggcagcgtggtcgccgtctcgtcggccaccgcccccatcggcgccagcacggccgctgcggcgatcactccggcgctaccccgtcttgagaacacccccgtcatgcctccgtccttccccgtctccgtcgcccgcccgagcggacctgcccccgggcggatctgtcaattaatgcgaatgcgcatcattcgcgataactgcagctataaaacaaacgggacggtcccgtccagttaattggagaggcgttcggaactggccgggatcggtccgcgtgaggtacaactgtcccgtccgacccagggtggtttcgccgccccggtcacacggacgagcccggcgcgcccccgcacgcagacggggacagacatggcgggagatcaggatgagatcgggacgatgaccagccaggcgccgcaacagcaggcagaacggccccgccggggccggccgtcgaaggaagatgcggccgaaacctcgggccggatcatcgagacggcggcgcagctttttgccgcgcagggtttcgccgcaacctcgatcgaacaggtcgcggctgcgtgcagcgccggcaaggacacgatctaccggcgcttcccgtcgaaaatggcgctgttcgaagcggtggtcgacagcctgcggacccggacgctggcacggctggagcaggaaatccgctcggccggcggcgcaggcgatgcgctggcgcggctgaagcgcatcgcccgctggtttctggacgtcaacctggatccggagatgatcgccttcaaccgcatcgcgctcagcgaggcggtggtcttcggcgacggccggcatgatcagtgggaaacggatccgatcctggaccggctggtcgccctggtgcaggaagcccagggcgccggagcgctggccgccggcgacgcccgggtggtcgccacgcatcttctgcatgcgatcgtctttggccccgccaccgacgccatgatgggccgcgccggctggaccacggcaaccgcccgcgaccgattcttcgatcaggcctggacgctgttcctgcgcggggccggcagctgacggccggacatcaccccccggctgtcacccagcgggcgacatcctgccagaccagcgggccgtgcaggtcgcgcagcagcatgtgccagccctgggggtaggtgttgatctgcaggtcgtcgcggccatgggcgatcagcttttcgcggaagttcttcaccgcccggcggggcagcacctgttcgttgcggccatagagcgccagcaccggcaggttaagcgagcccgccgcctccgtcgcccgttccatcagatcgaccaggccgaagatcgcatcggcacgggtggtcttcagcaccagcgggtcgcggcccagcgcatagagcatggcgtcgttgtccgacggccggatgccgagcccgccgccgtcgagcggcagccagggcatggcatgggcggtggtccacagcatccagcgctgatagggctgaagcgtcgaccagccccagaccgcgggcgccaccaggatcagcccggcgggcctgagttcggccggcagttcgcgggccatgcgcgccgccgccgacatcaccacggccccgcccatgctctcccccagccagtagaccggtacccccggatggcgggcggctatggcgcgggtggcgtcttccagatcatggatcagggcagaggtacccggccagatgccggcgcgcggcgcctcgccgaagccgcgctggtcataggcataggtctcgatcccacgggcggcccaccagggggccggcagggcgaaggcgcggcgataatcgttgaagccgtgcaggccgatgatcaccgcccgggtccggatggcggcaggcggggcccagtgccagagcggcagggccgtgccgtcggccatggtcagcgtcagcgcctgcggcgccacctccgccccggccgagatcgccgccgggctggagggctccgccagcaccagctgcgtttccttccaggcgatcgccgccgcctcgggcgagggatgccggcccttcagagaggccggcggcatgtcgcccgccgcatcgatatcgcccaccgccggccgcggatcggtcgcgatcgcgaccgcatgacgatcggggcctcggccgatcgcaagcggggcgcagcccgccgcggcggcggccgccatcaggaatgccagcatcagaccccgcctccccaagcggccacgccgcgtcacccgatccgctgcccgcggcaccatcttcagcggccttcgtaacccggcttgcgcttggccaggaaggcgcccagaccctcgtcgaaatcatgggtgcggctgttggcgacgaaggcctcctgctcgcgcgccagctgctggcccagcggattgtccaggctttccgacaccagacgccgggtgcgggcataagagagcgtcgggccggccgccagcttcttcgccagcttcatcgcctcggccggcacctcggccgcaggcacgatgcggttgaccagcccccaggcccgggcggtttcggcatcgaccggctcgttcagcagcagcatttccatcgcgagcttgggcccgatcagccgcggcagcgcgaaggtggagccaccatcgggcgtggcgccgatgccggtataggccatcacaagcttggcctctgccgccatcaccaccagatcgcaggccatggccatggaaacgcccgcgccggccgcaacgccgttgatgccggccacgaccggcttggacagccgggccatggccagcacgatttcatggaaggcgccgaccagggcattggcggcccgcggccgttcctcgcccgtggcaccgtgcagatgtgccagatcgccgccggccatgaaggcgcgtcccgatccggtcagcagcaccgcccggaccgcgggatcgccatcgaccgtcaacagggcttcaaggaggtccgcgcccatcgccgggttgaaggcgtgcagcacctccggccggttgagcgtgatggtcgcaacaccgtcggcgacggcgagggtgacggttcccgaaccgatcgggcgggcggtctcggtcattggggcgctctctccggatcaaggtcccccggcgacacgacatccgccggccaccgggggcttcttctacttcagggcgagcactgtatcagcactcgcaatggccgtcagcgggcgacgttttcgtacagcaccgccatgccctgcccggcacccatgcacatcgagacgatggcataacgctggccggtgttcaccaggtggttcatcgccgtgatggtcatgcgggcaccggtcgctcccggaggatggccgatcgagatgccgctgccatagaggttggtgacgtcgcgcgggatgcccagcttcgcctcggcatgcaggttcaccgccgcgaaggcctcgttgatctcgtaatagtcgatgtccgagaccttgagaccgcgccggtcgagcagcgcctgaatggccggcaccgggccgcagcccatgatgcgcggcggcacgccgacgatcgcccagtcgaccagacgcaccaccggggcgacgccctcggcttccagcgccgcacgatcgccgaccaccacgaaggcggcaccgtcggtcacgccgctcgaattgccgggggtgacgcggccgcccttgcggaagaccgggttcagcttcgccagcttttcaagcgtcacctccgggcgcgggaactcgtccatctccatcagacgggtcttgcggccctcgggcacctcgatcggcttgatctgggcggccaggaagccgctcttcatcgcctcgccggcccgctgctggctcatcagcgcccattcgtccatggcctcgcgggtatagccatagtcgtcggccaggttctcggcggtctcgcccatcagctcgcgactgaacgggtcgcgataggcccagtccagggtgtcgatcacctggccgggaccgcgcttcatgccccagcgcgcgccggtcatgacatagggcccgcggctgaaattctcaccgccgccggccagcgccatgcggccatggcccgagatgatctgctcggccgcggtcaggatcgcctgagtgcccgagccgcaggcgcggctgacgttcagcgccgccgaatgctcggccatgccgaccttgagcgcgatcgcccggctggcgaaatagccgtcatgatccacgggcagcacattgccccagaccagatggtccatcttgtcggcgccgatgccggccttttccaggcaggcgcccgccgcatgcacgccgaggtcgaccatgggcacgtctttcagcgacttgccgtagtcgccgaacggcgtgcgcatgccgccggccagcacgatctcggtcatcggtttctccctgagtttctggttcatgatccacggatcacccggacatgcgggagtccgttccgcggcagagcatccgccagccggcgcgccagggcaaccccgatgaatccgcattcatcgcgggcgttttcgcccccgccggccaggaccgtcgatcgtacttcaaacactcgtttgtttgaagtaggctgacccacagcttcgacagcgccccgcggcttctaccggggcgcgatgctcacccctgacgagagacgagagatgacccagaaccgccgcatcatcctggcctcgcgccctgtcggcatgccgacctccgcgaacctgccgatcgagacccagaccctggccgagccggccgagggccagatcctggtcaaggtcatctacctgtcgctggacccctatatgcgcggccgcatgaatgccggccggtcctatgccgccaatgtggccgagggtgacgtgatggtcggcggcgccgccggccgggtggtcgcctcgaagagcccgaagttcaaggaaggcgactacgtcttcggcatgttcggctggcaggaatattatctgggcgatgccgccggcgtgcggaagctcgatcccgcccaggcgccgatcagcacctcgctcggcgtgctcggcatgcccggcatgaccgcctatgtcggcctgctcgacaagggccagcccaaggaaggcgagacggtggtggtctcggccgccagcggtgcggtcggcggcgtggtcggccagatcgcgaagatcaagggctgccgcgcggtcggcatcgccggcgggcccgagaagtgcgcctatgtggtggacgagctgggcttcgatgcctgcgtcgactacaaggcgccggacttcctggaggccttcaaggcggcggtgcccaagggcgtcgacgtctatttcgagaatgtcggcggcaaggtcgccgatgcggtgttctcgcgcatgaacgatttcggccgcgtcgcgctctgcggcctgatcgcccattacaacgacaccggcgcgccggaaggccccgacaacctgccgcgcttcatgttcaacctgctctcgcggcgcctgtcggtgaacggcttcatcgtcagcgaccatcccgatcgggcgggcgatttcttccgagacgtctcgggctggatccgcgacggccagctgcgctatcgcgaggacatcgtagaaggcgggctggacgcgacggtggaggccttccagggcctgctgaccggccgcaatttcggcaagctgatcgtgaagatttccgaggacaccagccgcgccggctgaccgcggaagggttgcggagcggggcgtggataaccgcgccccgttcatctgtagatcgtgtctaaatcttaatttttctgacttatagatgtagctcggcggtcgatcgggcgtttttcgcccgggccgggcgccacaacagtggcagaggactgcgctttcccgtcatagtgaacgtggtccgccccacccgatgcgagttttgtcgaccgatgccaacccgccgacaccgcaccccccgcccctttttcgcggacatcaggccatgaccggcgtgctcaccgacggtcaggtggagaccggagccgatgccccgcaggatgccgccgagacggtcgtcgcggccgcgtccgaagccatgctgatcaccgacggcgaaacccgctcgggcttcctcaacaatgccgcctgtcgcctgatcggcagcgatcgccgccgcctgggcttcgtgcggctgatcgcgctcgtgaacggcatggttcagcgggcggccagcgaccgctcgtttcgcagccatatcgagctgctcggcaacgaccggcaatcggcccatgcctcggtgctgcgcatgcggggcgtcaagccgcgcagcttttcgatcacctcgcagcccgtcgatcctgacggccggcgtcagctttggatcgtgcgcgacgaggcggttctgtcccgccaggccatggattgccgcagctgtgcgggcgaggcccgatcgatccacgacgccctgctcgcccgcacccgggccctgagcgaggcacgcgatctggccgatgccagccggatggtcgccgaacaggccagccgggccaaaagcgagttcatggcccatctgagccacgagctgcgcacgccgctgaatgccgttctgggcttttccgaaatcatcgcccgcgaattgctgggcccggcggccgtgccggcctatgtcgattacgcccgcagcatccacgaaagcggaagcaccctggtcggcctgatcgacgacatcctggatctgtcgcaggtggaaaccggccgggttcaggtgcggctgcggcccaccgatctgaacgagctggtgaacgggctggacctggatgaagacctgcggcccggcgtgcggcttgccaccgacctgctccaggggcggatcgtcgttccgggtgatcccgacatcctgacgcgtgcggtgctacacctgcttgacgtgtcggccaatgtcgcgccggccggatcggcggtcaccatccgcaccttcgacaccggcacccatgccgggatcgaggtcatcgatgccggatcggtgatgagcgcggtcgagatcgagaatgcgcttgccgccttcggcgacaccgacagccagatcgcccgcagcggtcgcggtcgcggtgtcgggttgtcgctggccgatgcgctgatccgcctgcatggcggccgtctggtcatcgccccgcgcggcaatggcggcatggtcacccgggttctgctgccgcgcggctgaagcccgtccatcgcccgtacccgtccctcgcccgtacccgcccctcgcccgtacccgcccctcgcccgtacccgcccctcgcccgtacccggccgtcactgcatatccttgccgggatcgggcgcggtagcgtcgtcgacggcgcggaagcccatcttccggccgtcagaggtgacgatggtcaggcggttgccctctacctctgcctggcgggcggcgagcaggccgtcgatcaggtccatctcggcatcggtcttctgccggtcgcaggccatgcgcgtggcgccgatgccgccgaaacgcaggctgcccggcaggtcgtcgaccccggtctgatagcggccgaacatgcggttgcagggaccgcgcgccgacatgcggccatcctcgtgaaacctgaaccgggcggcttccgcccccggtgccgccggatcgggcgcccagaccgtgccggtcagcggcaggtcgggccggctgctgccgtcctcaccttgcatgccggcacaggcccccagcgccagcggcacagccaccgccgccatcaggcgcagggaccggaagcggcggggtccgaagcgcagagacgggcacccggccgatacggggcgatgcgcgggtgcggaactggcgggcatgacggatcctcctggggcctggctggtggcggcgtctttgaacgtcgcgacaccgatcctgcccgcacggatcgcggcttcccagcggcaataccgtgacatgaccgtcaccgaaacggcccgcgacaggatcaggccgtcaccgggtcggtcaccacatcgaaatccatgggcgccgggctccgatcggccagaggcgggcggccgtggccgatggggcggcgagcgatgctgccgggggcctgaagctggtcggcctgggcatcggcctggcgaagggtggtcatccgggtgtcctcggtggaagccatgatcgtggtcatctgaagcggttccgtcggatccggcagccgcgtggctgccgtcattgctggggatcgccggaaccacccccgggtgcgggaggcgggtttcgcagggccagaacgcgaaacggccgcctccgtttccggaggcggccgtcgatttcgggatctcgtcaggccctcaggccggcacacccgctcgattggccacccccggggggctccaccaatagaacgtaaacgatgcataggtgcgcgacgtgatcatgggcgccagtctgatcccgccccgccctgccgtcaagccccgaccgtgcggcaacggcgcgacgatcaccagccgccgcgcgccagccagcgatcgaccatcgccagccggtcccagccccagaacggctcgccgtccaccagcacgaaaggcgatccgaacacgcccctggcgaccccttcttcggaaatggccttcaccttctccttgatcgcaggatcggccatgccggccagaacctcttccgcatccagtccgcggcgggcagccacgccggccacgactgcaggatcggtcatgtccgcctgttcgacgtaataggcatggaaggcgtcccgggcgaaggccaccgccgccgcgggatcgcgcgcctcgatccaataaaaggcgcgcgaggcgggcagcgccacgatcgggtggccgggcggcagggtgaaggggatgccggtctcccgcgaaatgcgccgccagtcgttgcgggcataatcccccttcagcggcgtgccgctcagcccgcgcatgcccgtggccttgaaggccacgcccagcatatagggccgccagatcacctgccggccatggcgggcggccagggcctcgatctcgtgcgatgcgaaataggcataggcggagctgaagtcgaaccagaactcgatcggggcggtcatgggcttttccatcgcctggagtgatgccgtcggagatggttctatcatgcggcacatgtcttgcgcaaagtcgccggcagactgcccgccccgtggacccggagcatcgcgctcgcaggatttcgtggcaggatggccccggacccaccccatgatcacaggacttcccgatgcgtctcgtccgttacggcctgcccggccaggaacgccccggtcttctcggccccgatggcggcctgcgcgacctttcaggccagatcgccgatctcggccccgccacgctcgaccttgcgaccctggaccggctgaaagccatcgacccggccagcctgccggcggtcgacggcccggtccgcctgggtgcctgcatcgcgcggccgggcaagttcatcggcatcgggctcaactatcgcgaccacgcggccgaagccggcatggccctgccgaccgaaccggtgatcttccacaaggccacctcgtgcatgacaggccccgaagacgatctgatcctgccgccggatgccgccaggaccgactgggaggtcgaactcggcatcgtggtcggccgggtgctgaagcgggtgagccccgaagaggcgctggccggcgtcgccggttattgcacggtcaatgacatctccgagcgcgccttccagctggaccggggcggccagtggaccaagggcaagtcggccgatggtttcggtcccgtgggcccctggctggtcaccgccgacgaggttccggacccgcaggccctgaagctgtggctggagctgaacggcgaacgccggcaggacggcaccaccgccgatcaggtcttcggcgtcgccgaggttctgtcctatctcagccgcttcatgacgctggagccgggcgatctggtgaccaccggcacgcccgccggcgtcggcatgggcgccaggccccagcgcttcctgaagccgggcgatcacatggtgctggaagtcgaaggcctgggccgccagtcgacccgggtgacggaagaatagctcctgcctttgcatgctcttaacatgccggggtcttgcatcccgtgaatcggggggcgcgcgtcggctgcatgtggacgccgtcacctcgagccgtctacaatcagacatccggaaaattgtccggtgatcgatcaatcccgggttcacagagtgcacggccaggttgcggtcgggcacggccgggttgcggagggtgggcccgatggcgggcgccctcgtccggacgatggtgacagccggcagagcggcattccagggtgatggcatgcgcagacgggtgcttgcggtgacattgacgctggcgacgctcatcggggcgttgccggtggcaggcagcctttggatcgcctgggaaaacgcccgccgcgtcgaaaccgatctgctgatccgggccacccgggaaatgctcacccgatcggaacgtctgcaggaggatgccacccgcgcccttgccgcgatggcggcggtgccggtcggcgatgcctgcacgcccgcgggtcttgcccgcctgcgcaccgccgccttcgccagccgcggcgttcgcgaggtgggggtggtggaagaggggcgcgtggtctgtacgggagcaggccggctcgacagtccgatgcccctgccgctccccgacatgtcggtcggcgacatgcggatctggtatgaccgtctgcccccggggctggacgacagcgcccgtgccgccagccgcaccacggtgattgcccgcggcccctatgcggtatttctggataccgagcagatctacgatctggtcctggcggaaccgcgcgtggtgttgagcatggtcgccctcggcaccggccaggtgctgggggtgcgcacccgcccggaacgcgccatcctgtcggatatggtcgaccggttccgcaaccagaccgaacccgaggccatccgcctgggcgaccggctggtggtggcggccaccgcccgcgacggcaccgccatggcgctcgcctcggaaccggtcagcgtggtgatcgaaacctggcgggaacaggccctgctgatggggctgcccgggctcgccagcggcggcctcatcttctggctgatcgtcacccttgtccggcgcggcgacacaatgggcgcgcgcatccgacgtggtctggcgcgcggcgaattccgggtggtctatcagccgatcgtgcgcctggccgacggcgcctgcctgggcggcgaggcgctggtccgctggcagcagcgcgacggcagcatgatctcgcccgaccgcttcattccggttgccgaggccgaagggctgatcgagcggctgaccgacgagatcatcgagcatgtcttcgccgatctcggcaaattcctggcggcacgcccgtcggtctggatcgcgatcaacctctcggcctcggatgtggaaagcgaccgggtgcgcggccggctggaccggctgcgcaagacccatggcgtggcggccgcccagatcgtgctggaagcgaccgagcgcaccctgatcgatgccagacgcgcccaaagctccatgcgcagctttcgagatgccggctaccggctgacaatcgacgatttcggcaccggctattccagcctcgcctatctcgccaccctgccggtggacgggctgaagctcgacaagaccttcgtcgacggcatcggcagcgggtctgccgccgacgacgtgatgggccatatcctgtcgctggcggcgacgctcggcctggatgtcgcggcggaaggcgtcgaacatcaggcgcaggcggattatctgatcgcccgcggcgttacctacggccagggttggctctatgcgcgcgcgatggatggcaacgccttctgcggctatgtcgacggccatctgccggcggcaccgctggcgaaccggcggcgcgcctgagcggttcatccgccggcaccccgtcagggttcaatccccggccacagggtcaggcacagcaccccgaaaatggcggtgatccggtcgggatcgtccataccgtcccccaccagcggcagttccagcgcgtcgaacagataatgcgcccgcgaattggcaaagctcgtgtcgccatgcgaccggaccggcgcacggcgccggatgacctcgtcgaagctccgggccaccatccggaaagtctcgggcgggtagacctcgtccagccaccagccggtccggtcgcggcccagccgctccacgatcgtggagccgatcagccggtagcgatagcggatcgcatggtggccaccggcgtcttcatgcccctgtcgaaccacatcgatcagatagctggtggccaggagatgaggaaaggcgagtggatccagatcccgccgccgaaggggccgccccgccccggtcgcccgttgccagacggccagcaccggcatcagccgctggtcaaggccatcgagtgtcgcttcgacgatgtaggacacgttgccgacgcccccttgccgccatcgggccggatcatgccgcccatcgtctgcacccttgccgacctttccgacgcctgcaacaggaagtgagcaggtagtgcaacatgcaacgcgtccaccaccgtaaacgttaaatacattcattcaataagcgcataacgcgccaatcccgacgaaaatgcgggatttttgccaccgttgcactatcatgacgtttgaagcccgagaagaggccatccgtgggatgagttcccggataagaacctgaaagctgccgcaaccactcacgcggatgcacaggatcacgccgaaaccagtcgccaagacgaggtcgtcgaagatgcgtcatgacatcaccccgcctgcgggcggccggtcgcccggaggggcagccgccgcgccggagcttcgttctgctcattgcaccaccggtcagccgaccacagccccgcccggcccggtcacgcctgcatcggccatgcccgatgacgccgcggcggaaacggcccagagcgcgaaccgccgcgacatagaaaccgagatcaaccgcgccatcggccggcggatccggacgctcaggctggcgcgcggcttcagccaggaagcctgctccacccagctgggcatcagcttccagcagctgcagaaatacgaaaagggacagaaccggatcagcgcctgtgcgctctatcgtctggccggaatcctggatgtcccgccctcggcgctgctcgaccggctggacgacgggcccaaggtgctccgccgcaaccggatcagccgcggcatgatcgaggccagcacccggcttgcctcgatttcggatgcgactgcgcgccgggcaatcaccgatctgatcgccgccttgagcagcgccgccgcagccggggacgccgaagccggcgatgacgatctcgatctcgatcagaccggcgccatgcattgatccctcccgtccgcactgccggccatccctgatggcaagccgggggccgcaccgacgatcgtcggtgcggccccctttgtttcgcgcaaggtattccagagggcgcattccggatggtgcgccgcggatcgggcgctgcggaggggcggggttcaacccgcgacatccggcttccccctcgcctccccgcgacgcccgggttacgatccgaaacgggaggatcgatcggccggccaggatacgtgcacaacaattatgcatgaccggcgaattgtccaaaatttacgcaaaccagccgcgaccgtacctgtacagccgcgaccgttcttttggggaaagcccgccgaaacctatccgatcggtcaggtaaaaacctcttgcggacaatgggttgaaccccgatcgtaaaataaggtgcgcccttggcccggggattgcaccagcagagacaaagagtggcgggcggcagcggagggagaccggtgccgacatcgccgcgggccagctcgtgaggccgagacgcatggcagaaccgatgaccatcgacaggacgcgcgatgacaggcgcgcacaccggtcgacccccgcgaggggtggaccgccagtgactgcaccgaccgggaagccggggggacggagtgccgggatgacggggaagacggggatggcggcagtgtccgcacgcggattgtcgctggtctatcagaccgccgatcagccggttcatgcgctcagcgacgtggatatcgacatccgcccgggggatttcgtctcgctgatcggcccgtcgggctgcggcaagaccacgctgctcagggtgatcgccgatctggagcagccgaccggcggcagcatcaccgtcaccggccgcacgcccgacgaggcgcgccgcgcccatgcctatggctatgtcttccaggcgccggcgctgatgccctggcgcaatgtggaacgcaacgtcatgctgccgctggagctttcaggccgccccaaggccgagcgccaggcgatcgcgcgcgaaaagctggccctggtggggctggacggttttgcccgcaaatacccctggcagctgtcgggcggcatgcagcagcgggcatccatcgcccgcgcactgtccttcgcgcccgaactgctgctgatggacgaacccttcggtgcgctcgacgagatcacccgcgaccatctgaacctggcgctgaatgcgctctggcggcagaccgggctgacctgcgtcttcgtgacccattcgatttccgaagcggtgttcctgtcgaaccggatcatcgtgatgagcccgcgcccgggccggatcctggaagaaatcgtctgcgacctgccggcagagcgcacactggagatgcgcgagagcgccgaattccagcgggtcgcggccctggtcagggcgggcctcgccaagggccactcctatgactgagcttgcggccaccgccccgggcccgcgtgccggccgcttcggccgcgcgctggtcgaacggggcgccgacatcctgccggtgacgacggtcgcccttctggtgatcgtgatctggtatgccgcggcctatctgctcaacaccccccaggcggcggaacagctggcccgcaagggcatcaccgaccccggcttttcccagttgatgaccgaggccttcacccagcggcggccggtgctgccgacacccgatcaggtggtggtggagatcgtcacctcgtcgaccgagcggccggtgggcaatgtccgcaacctgatcacccatgtgatcgcaaccgcgcaatccaccctggccggcttcgtgctgggctcccttctgggcctgggccttgcgatcggcatggccgccctcaggccgctggaacgcggcgtgctgccctggatcgtcgcctcgcagacggtgccgatcctggcgatcgcgccgatggtggtggtggtgctgggcaatctgggcttcaccggcctgctgcccaaggcggtgatctcgatgtatctgtgcttcttcccggtcgcgatcggcatgaccaaggggctgcgctccgccgatccgctgcatatggatctgatgcattcctacaacgcgacaccgctgcaggtcttcctgaagctgcgccttccggccgccctgccctatctcttcgccagcctgaaggtggcgatcgccgccgcactcgtgggggcgatcgtgggcgaactgccgaccggcggccaggccgggctcggcacccggctgctcgccggatcctattacggccagaccacccagatctgggcggcgctgatcgcggcgtcgctgctctcggccctgctggtccaggcggtggcgctggcggagcggatcgtggtccgccggagcggaggtgcgcgatgaccacgacatccaccgcaccctcggcccctctccagcccgtctcgcgcggtctggatgccgtctggggcctgatggggctcgtcgccctgctgctgcccctgtccaccacgggcggcgcctggatcggcaatgccgatctgaccgttctgctgatgatcgccggcatcctgctctttgcactggccgggctccggccgcggcgaagcggcatgcgcgggccgctggtgctggcgggggcggccctcaccgccatcgccacgctcgtggcgctgcgcagcggcacggtcggcttcggcgaaggcggtgcgggctacacccttgccgggctcgccgcgatggccgcggcctttcgcggcatcgccctggtcgcgcgcctgccccagacctcgctgccggtgcggctgctgccgccggccgccctgggcctgacgctgctctatgcctgggagggcggctgcctgggcttcggcgtgccggcggtgctgctgccgccgccatcggcgatcggcgccgcctttgccgccaacctgccggtgctctggcaggatttcgtccagaccgtgtggaagggggcgctgcgcggctatctgatcggctgcaccgccggcatcctgctgggtgtggcggccgatcgcgtcgccttcctgcgccgcggcctgctgccggtcgccaatctgatgagtgccgcccccatcgtgggcgtggcgccgatcatggtgatgtggttcggcttcgactggccgtccaaggcggcggtggtggtggtgaccacgctgtttccgatgctggtgaacacgctggcggggctttccgccacctcccggcaggaactggacctgatgcgatcctatgccgcatcccacgccaccacgcttctggtcgcccggctgccgaacgcattgcccttcctgttcaacgggctgaaaatcagcgcgacgctggccctgatcgcggccatcgtggcggaattcttcggcacgcccgtggtcggcatgggcttccggatcagcaccgaggtcgcgcggatgaatgtcgacgtggtctgggcgacgatcctggtggccgccattgccggctcgggcacctatgccgcgctgtcgttcatcgagcggcgcgtgaccttctggcatcccgcgatgcgcgggcgctgacggcgcccggccagctgatgcggagacggcgtcccgggcgggaccatcggaggcttcggcccgcccgtggatgattttgaggggagaccccgcgatccgccgccgccccacaacgggggcaaaccccgccggcggccggtccgggacagatgatgacgagggagacgagaatgaggacgctcaagaccctcctgaccggttcggtcgccgggattgccctggcactggccgcgacgggccccggccttgccgccgatgcgctgaccctgcagctgaaatgggtcacccaggcgcagttcgccggctattacgtggcgaaggaaaagggcttctacgacgaagccgggctcgacgtgaccatcaaggccggcggtcccgacatcaacccgtcgcaggtgatcgccggcggcggcgccgatgtcgtggtcgactggatgccttcggcgctggccacgcgtgaaaagggcgtgccgctggtcaacatcgcccagatcttccagcagtcgggcatgatgctgacctgccgcaaggacagcggcatcaagaccccggccgatttcaagggccataccctgggcgtctggttcggcggcaacgagtatcccttcctgtcttggatgtcgacgctgggctataagaccgaaggcccggatgccgacatcaccgtgctgaagcagggcttcaacgtcgacccgatcctgcagaagcaggcctcctgcgtgtcgaccatgacctataacgaatactggcagatcctggatgccggcatgccggccgacgagctgatcaccttcaagtatcaggatcagggcgtcgccacgctggaagacggcctctataccctggagaagagccttcaggatccggcaatggtcgagaagctgggccgcttcgtgaaggccagcgtcaagggctgggaatacgccgcggcccaccaggacgaggcggtggaaatcgtgctcgacaacgacaccaccggcgcccagaccgaagagcaccagacccggatgatgcaggaggtcgccaaactgctcgacggttcgaagaagggcatgggctatctggcgcccgaggatttccagcgcacggtgaaggtgctgctgggggccgaatccgccccggtcatcaccaaggatccgggcgaggccgcctggacccatgcggtctacgacaaggccatgtgatcatgtgccatgtgatgtgatccgccaggtcacgtcgaaacacttgcgtcctcttacgccgccgcccaggatcggacgatccgggcggcggtcgcatttcgggccatgcacgaccgcctgccccggtgatcgaaaggaggacgaccgtatgtcgatgtcgcggccccgccgcattctgcgccgcctggttcgccggcgcatctgcctgagggatgccggcatcatcgccgtggtcatggtcgtggccggctatttggcggtcgccttcgacctgttcgaagcaagtgaacatgccgccgacacggcgaccgcaatgctggaactcgacgaggcgctggcgctgggggtgctgctggcgctgatcatgctgggggtggcgctgcgccagtaccgggagcagagccgcgagatcgcccgccgtcgcgcggcggaaaccgaggcccggcgcctggcctatcaggatccgctgaccggccttgccaaccggcgccgcttcgaggagcgcctcgcggcggcgatcgccgctccgccggccgcgggcgccacccacggcctgttcctgctggacctgaacggcttcaaacaggtcaacgacgtttatggccacggcaccggcgacgaggtgctgatggtggtcgccaaccgcctgatgggcgcggtgcgcgacagcgacctggtcgcccggctgggtggcgacgaattcgccgtgctcgccccgcatctgatggggccggaagccgcgaccagcgtggcgctgcgcctgacccgcgccttcgccgacccgatcgccagcggccgcggccggcacgatgtcggcaccggcatcggtatcgccctgctgcctcaggatgccggggatccggtcgaggccctccggcgtgccgatgtggcgctctatcgcgccaagaccgagcgccgcaccgctttccgcttcttcgagagccagatggacgatgcggtccgccagcgcgaggcgctggagatcgacctcagggcggctgtggccaaaggcgggctcgacctgctctaccagccctcgatcgaactcgacaccggccgggtgacgggtttcgaagcggtgatcagctggcggcatcccgtccatggcgacatcccgcccgaacgctttctgccgatcgccgaagataccggcctcatccacggtctgggccgctggatgctggtcgaggccgcccgcacggcggcaggctggcccgccgacgttctgctgtcggtcgacctgctgccggggcaggtgaaggatccggccttcgccgccgatgcgcagggcatcctggccgaagccgggctgccggcatcgcgggtcgagttcgacatcgccgaaagcacgctcgtcggcgatccggatgccgtccgcgccctggtcggcgatctgagggccgcgggtgcgcgggtggcgctggccaatttcggcaccggctattccagcctctaccatctgcgcgatctggagctggaccgggtcaagatcgaccgcagtttcatccagcggatcgacgaggcggagaccgcccggctggtgcaggccctggccgggctgggcggcgggctggggctcgacgtcggcgccgaggggcttggcacgaacagcagcgccgccgcagatcgcttgagggccagcgggatccgcaacgcctccacccgcgggcagagcgtgacggctgccgaaagcctgggcatgatcggggccacagccaccccgcccaccgcctgacagccggagcccgcgcccccatgttcgacgccgcccccatcgacaccgacgcgacccccaagcccgagctgtaccgcctgctcgctcgccagctcgacgccctgatcgcgggcgagcgcgacccggtggccaatgccgccaacatgtcggccctgatctggatgtcgctacccggcctgaactgggccggcttctacttcctgaaaagccccgacgaactggtgctcggtcccttccagggccggccggcctgcgtgcgcatcgcccgcggccgcggcgtctgcggcaccgcggtcgccgaaggccgtacccagctggtcgaagacgtccacgccttccccggccacatcgcctgcgacgccgcctcggcttcggaaatcgtcgtgccgctgatccgcgacggccggatcctgggtgtgctcgacctggacagcccccaccccgcccgcttcgacaccgaggaccaggccggcttggaacgcctggctgcgatctgggtggcggggagcgattgcgcctgagcggatgatcgccgccgggggagaaaggctcactgccgcctcccccggccatgcgtcaccggaacagcaccagcgccttgtcgagggtgatccacaccccccagaggatcggcaggccgacggcggcccaggcgaggggggcgcgggtgtcgatgccgccgcggccgatgccgaacgagccctcatgcgcggcatccaccgggcggagcttcgcctggatctcggccagttccgtcctgccgatgaaccagcgctcggccagcggccggatcgccaggttgcagaggaagcccgccgccagcatcgccgccagcacgatcatgatcgtgtcgtagatctggggccgcggcacgccggcggcgatctgggcgtcgcgcatataggcgaccaccagcggccccagaatgcccgcggtcgaccaggcggtgagcaggcgaccgtggatggcgccgacgaactgggtgccgaagatgtcggccagataggcagggatggtcgcgaagccgccgccatacatcgaggcgatgacgcagaaggcgagcacgaacagcgccagcgcatggccgcccgccagcatcggtgccgccagatagaggccggcccccagcacgaagaagatcgcataggtggccttgcggcccagatgatccgacagcgaggcccagaagaagcggccgccgatgttgaacagcgagatcagccccacgaagccggcagcgatcgccgcggccgagagtttctgctgctcgtcgaagtccaggaagccgacatcgggggcaccgaccagcgcgccgccgaagatttcctgcagcatgggtgccgccacgccgatgatgccgatgctggccgagacgttcaggcacagcaccgcccagatcagccagaattgcggcgtcttatgggcgtcgcgcagatggacatggccatgggtgatcatggccttcgacgccggcttcggcgtccagccatcgggccgccagccggccggcggcacgcggtagccgaaggcccccgccagcatgaacaccagatagatcgcgcccagcgccaggaaggtttcccatacccccaccgaatcaggcgtgcgaaagtggttcatcatcatgttggcgagcgggctgccgatcatcgcaccgccgccgaagcccatgatcgccatgcccgtggccatgccgcgccggtcggggaaccatttgatcagggtcgagaccggcgagatgtagccgaggcccagaccgacaccgccgatcacgcccgagcccagccacatcagccagagctgatggctggcgatgcccagcgccgacaccgccatgccgccgcaccagcagatcgcggccacgacgccggccttgcgcggccccgcccgttccagccagccgccgaaggctgcggccgaggttccgagcaccacgaagaacagggtatagatccagaccagatcgctgatccgccagtcgcagctggtggtggtcagcgccgacaagagcgtgagatcggcgcaggcgaccggctgggtcacgccgatcgcacgcgacagcggcagccagaagacgctgaacccataggccatgccgatgcagagatgaatggcaagcgccgccggcggcaccagccagcgattgaagcccggacgggcgatgatgcgttcgcgatcgagcagcccggggcgggcgcccgggccgtcggtggcggcgatctgaaccatggcgtcgaattcctccccagcgacgcggatctgcggggggcccggctgccctggcacagcggggaaacgggctggcgatgcgcgatggcgcgcacccacgacccgtcatccggccccgacatgccgaccgatctgcctgaaagcttccccgcccggtggtggtggcctttccagcctctttcacctccggtcgaacaacgctgggtcatcccgcgccccggatcaaatcgaaacgaatgaacgtttaatcaccgtcctctatcaacccgggcgttttcccgggcgaaatcccgctcgaaatccgcaccccgcagacaggcgagcagggccgcggccatgggcgacggcgggtcgcgatccgacagcaccagcccgaccgactgggtatggaccggatcgaccagatcgatcgagaccagatcgggcgtcgcccccagcacatgcagaaacgtatggggcacgatgctcgaccagccgccctggcggatatgggcgcagaccccgaggaaagaattgctcacaacgggcgcatccaccgtcacccccagcccggaagcgaccttgttcaggatccggcggttctgcatgtcctcgctgagcaggcagagcgtctgggtgaaggcctcggcccagcccagccggtcgcggcccgcgaaggggtgatcggggccggtcacgaagacatagcgttcacgatagagcggcagcagccggcaatgctccggcggctcgttctccagataggtaaggccgccatccagctcgaaggcgtcgagcccgcgttggatggcgcgggaggtgagcgactgaatggcgatgcgcgcggcgggatgagcggccatgaagcgtgcgctcagaaacgcgaccgagggcatcgccgccgggatcacccccagccggagggtgccggtcaacccgctgccgccgcccagatcctcgcgcaggctgtcgtaatcgcgcaggatctggcgggcccagaccagcagcttctcgccctcggcggtcagcccggtgaagcggtggccgcgcaccaccagccggacctccagatcctgctcaagcttgcggatcgcggccgacagggtgggctgggtgatgttgcagcgcgccgccgcccgggcgaaatgcttctcgccggcgagggtcacgaaataggagagatgacggacgagcatggcggatggcctccggcgggggcgcccgggtcagccatccgacactatcatatcaaggttgatgcgcccatcttccgcacaccctgcagacgagccgccccgcctatacccggcccggcaagcgcagggccacgaacatggcggtcaggccgaagcccgccatcaccatcagggtgatcgcgaaggcctccatggtctggccgggcagcgccgcctcggcggtttccagcaccaccgccaggatggcgacaccgaccgcgccgccgaactggcgcccgacattcagggccgccgccccctgcgccacctggctttcgcccaagagccggagcccaccggccgagagggccggcatcaccagggccagcgacatccgcccgaaggccatgatgccggcgatcacccagaaaccggccgagaattcggcccaggtgatcagcaccgcatgcagcgcgaagcagccgaggccgatcatgacctgcggccgggccggcatccggtccgccagacgtccggcgatcgggaacatcatcgccatggcgaaaccgccgggagccatggccagccccacctcggccgggctcatgccccgggcggtttccagcagcagcggcagcagataggtggagccgaacaggccgaggccgagcgtcatggaacagagcgccgccgcggcaaagcccggcgcgcgatagatcttcagatccatcagcggccgggtcacccgcctttcccaggcgaggaaggccgccgccgccgccacgcacagcaccaccagccccagaaccggcagcgacacccagccctgcgacttgcccaggctcaacaccccgatcagcgagacgagcgcggttgcaagcagcacgaagcccagcccgtcgaaccggccccccgccccggccggccgggcatcgggcagagccttcatggccagccccatgccgaccaggcagaccgggatcgccacgaagaagaccgaccgccagccggcgaattcgaccagcgcgccgcccaggctgggcgccagcgccggtgccagcaccacgcccaggccgtagagacccatggcggcgccgcgcttgtcgggcggatacatgcggaagatgaccaccatcgccaacggctggatcatgccggccgcggagccctggatcacccgggcggcgatggcggcatgagcaccgggcgcaaagccaccgagcagggccgcaccgacgaagaccgcgatcgccaggatgtagagcttgcgaaaacccagccgccccatcatccagggcgccacgggcatggcgatggtgttggcggccagaaagccggtggagaggccctgggcaaccgtatggccgacgcccatatcggccatgaaggtggcgagcgccacattgatcagcgtggccgagagcacggtggcgatggtgccgcacatcagcgccgcgatggcgagccgacgttcggtcgccgtgatcgcggggcctgcggtcacggcgggttcgggcagccgcgtctcgtcgtcggatccgtcgcggggggccgtcaccgggcacctccctgatcgtcatcggcagccgcggcccccgccagcagacggtcggtgcgggcctggatcatgtcgagcagggccagcgcctcgacgatgcgctcttcgggcacgtcgcccagcagatcgtcgcgcacctcggtgatcgcctggctgatcgtccgggtggccggggcggcattcggccccagccggatcaccttgcgccggcggtcgtcgggatcggcgcagcgcgtcaccagcccgtccgcctccagccggtccagcagccgcaccagggtcggtgcctcgatcgccagacgctcggccagttcccgctgggtcagggcgcggggctcggtcgccaccacattcatcacccgccagcgcgactgcgtcagattatgcggtgcaaggcgctggtcgagcagcgcccgccagctgcgcgccagccgcgcgacggtccagcccaggcgcgccctgggcggcgcgtccggaccggtggtgggaacgggaacggcggaattgaccggatcgatgacgggcagcatgacctgcagggcctcatggaacgaacgagaccgttagcctagcaaatcattccattaggtcactaacgttcctggtgcagccctggcccgcgcgccggtcaaggccacccgatcaggccccactcagtcaggccccactcagtcaggcccgcatgcggttccgcgcccgaagcgccagatcccgcgcgcccggcgactgggtgcggcccagctgctgttcgatccgctcccgctctcgctgcagcagggcgaccagctgggcgcggcgctcgggcgtcatccggctgtcgatcgcggcgatgctcaacgccgcctcgggttccccgcgccggttcaggatcggcacggccacggcgctcattcccgccacgatcagcccgtcattgaacgcatagccctggctgcgggtctggtcgaccagggtcagcaggcgctggggctcgaagcgcggcgcgtaggaattcacccgcccggcattcacgtcgatgatcgagcgaacctcgttcagatcgggctggaaggcgagcagcgccaggctgccggcgcccacgcccagcggccgccggtcgcccaccgcgagcgtcagcgtgcggatcgggaaggcgccttcctgccgctccacgcagatcgcatcgaagccggagcggaccgaaagataggcggtatcgcccgaggcttcggcgatgcgcagtaccgccggggccgcgatcttgcggatgccgaagcgttctgccgcaaccgagcccagcgcaaaggtctccacccccagatgatagcggcggctgcccgggtcctggtcgaccaggccttcgcgcatcagcaccagcagcaggcggcgcacggtcggcttgttcaggccgctgtcggcgaccacgtcgaccagccgcgccccgccggcatcgcgccgggccagaatgcgcaacaggctgatcgcacgttccaccgactgggttccggtgggggcggcaggcgccgcggcggggaccgcgggtccacggcgggcgggggcggcaccacgggcgggtgcgcccgtcagggtctcgggcatggtgacacgtttcctccggtggtctccgggctgccttcgaacgggccgctcacggggaaggtcgcgagggtgcgccaagtcgtccacgatggtccactatgtggacgtcttgccgatcctcttgcagaatgatgtctctgttacgtcgatttgacaacgtaacagatgatttgtagcttggtcttgagcgaaaagccaatccacatgatggaccggatagaaaggtccgcatgaaggaccccgccgggagcaacaccggcacacgctcagggcgcagggtccccccgcgccgcctggataacgagcagaacatgctgcccggcctgcgtcgccccagacgcgggccaagggcgcttccggggaggaaaaaccggtgacgaccgattccgtatcggcgccgcctgccgcagacaacggcaggcgtcggcgccttgttgaccatcacgccatgatgtggcgcattcgcgccttcgaacgggccgccgaggtggggctcgccaacggccatgtggcgggtgccgtgcacatgtccatcggccaggaagccgtggccgcgggcgtttccgcccatctgatcaaggcagacgtgatcgcctccacccatcgcggccatggccacagcatcgccaagggcgccgatcttcacggcatgatgctggaactctatggccgggccggcggttcctgcgccggcaagggcggctccatgcacatcgccgatttcgatgtcggcatgctgggggccaatggcgtggtcggggccggcctgccgatcgccgtgggcgcggcgcaggggctgcgcctgctgggccgcaatgcgatcgcggtctgctatttcggcgacggggcggccaatcgcggaccgttcctggaatcgctcaactgggcggccgtgtttcgcctgccggtcctgttcgtctgcgaggacaacaactggtcggccacgacccgcaccgcgaccatgagcgccggccccggcatcgccgcccgagccgaggcgctgggcgtgccggccgtcagcatcgacggcaatgatgtcgaggccgtggacgaaaccgccggccggctgattgccgatatccgcgccggcggcgggccgcggctgctgcatgcccgcacctatcggctgaagggccataccgtcaccgaccccgccccctatcgcccggcggaagaggtggcggcacggtgggaagacgatcccatcgcccgcaatgcggccgagctcaaggcgctgggtctggacgaggacgagatcgcggccatcgaagcggccgagacccggcgcatcgccgatgtggtcgcagccgccctcgccgcccccttccccgaaaccgctgccgccttcgacgacgtccaggatgtcggccgcccggtccccggggccgaacgcggccttgcccacacccttccggcggagcatctggcatgagcggcttcacctatatcgaaggcgcccgccgggcgctggcggaagagctggaacgcgacccccgggtctgggcgctgggcgaagatctgggccgcggcggcgtgttcaagcagtatgatggcctgcaggcccgcttcggcgagacccgggtggtcgacacgccgatctcggaagcgacgatcatgggcgctgcggtcggggccgccctggtcggcagccggcccgtggtcgagatgcgcttctcggatttcgccctctgcgcggtcgacgagctggtcaatcaggcggccaagaaccgcttcatgttcggcggccagggccgggtgccgctggttgtccgccagccgatcggcgtctggcgatcctccggcgcccagcattcgcagtcgctggaaagctggtgggtgcatatcccgggcctggtggtgacggcacccgccaccccggccgatgcctatgccctgctcaaggccgcgatccgctgcgacgacccggtagtacatctggaacacaaggcactctggccgctgtcgggcgcggcgcccgaaagcgacgccccggcggaactcggccgggcggcgatccggcgccccggccgtgacgtcaccatcgtcgcctggtcggcggcggtccacgaggcgcttgaagcggcccgcctggcggcaatggagggcgtcgaggccgaggtgatcgatctgcgcagcctctggccctgggatgccgattgcgtgctgacgtcggtcgcccgcacccgccggctgatcgtggcgcaggaggccgtgcgcgatgccggcttcggggccgagatcgtcgccaccgtcaccgaggcgctgggcgaccggctggaggcgaaaccggtccgcctgggtgcgccgcgcattccggtcggctattcggcaccgcttgaagccgcctatcgggtcggccccgacaacatcgcccgggcgatcaccgccatggcggcctgatcccccacccttccgcagcaccgctcaggcggtggccggatatcgatccccggtacctcccccgggcaggcccgacgctctcccccgagcccctccctgcccgaccggtgatccggccatcgtccgcggcgttccggcaccactccgctccctgcgtcctccctccgcgcgggttcggggacgcaccggaacgcaaaaccgccggcatccttcccccaggatgccggcggtttcttttttgatcggatggcgtgggtcagctggcggaggcgagcttcggcttgtccaccgccgccggcacgggcgcgaaagtcggccgaccctcgcgccagttggtctcggtccggtcgatcgcctgggtgagcgtcgccaccgtgggggcatccagcgcctcgggcagcgggtcggcgccgatcgacaggaacaggcggccgaaggcgttgttggcgtcggcgaaggccaggtcccggcgcagctggctctgcaccgaggccagctcggtctggatgacctgcagctcgcccatgctggtacccgccgcggccctggcctgatccaggatgcgggcatccagatcggccagttcgcgggcggtctgatactggatccgcgcctcgtcgtaattggtctgggcgacatgcacctgggccagcaccgccatgctgatcgccatgcgccgggcgtcgaccacctcctcattcgcttcggcgaccgccatggcgccggggatgcgcaggatgttgagcagattccaggtgaccttgacgccgtaatcggcccagtcgttgttcaccagatacttgttgctgtcgtaatgggccccgagatcaagctcaatgcccggcagcagccgcagcagcgccttgcgggtttccttctgcgagatgcgggtctgatagtccagctcgcgcacctcgggccggttggccagggccagcacttccagctcttccccggtggacgtcaccggcggcagagcggcctgggtttcgggcgcctccagggtgaaatcctcacccggacgcagattgatcagcgccgccagctcggtcttggccaggcgcagttcgcgcttctgcgcctgaagctggcgcagcgcatccagcaggccacggcgataggtcagcgcctcggtcggcgccctcagctgctgctgctcgatctgcgcggatgaagcgagcgccgtctcgatccgggtcatcagcgggtcgatgcgcgacagcacccgctccgccgccaccgcccgccaataggcagagcggacgtcctggatgatggtatgcaccacccggcggcgctgctcggcggcgatcagcgaccggtcggcattctgctgggcggtgacgtaagagacgccgaagtcgaggatgttccacgacatgttgaggtctgcgacccgacggttgcgctcggtcgaggtcgagggcaccagcgattcggtaccggtcgcgatgttctcgctgctggacgccgagacgttgtcacgcccgacgaagcccgccgaggccgccagcgagggcagcatgtcccagcgcgacagatccagctgccgctggctcagcgcctgttccatggtgcggagccggccgtccagattgtagaggatggcccgcgccatggcctcgtgcaggctcaaccggccggtcaccggctcctggttcgagaacatccgcgcaagatcggccgaaatccgtgcctgagtcatctcaggcgcgatcggctccggcgtcacggtgcaccctgccagcagcgccgcggccagcacgcccgccaccgccttgcggccgtgccgcccgatcccgttcattgctgcctgcccccgcatatgctcaccccgtctgtccgcggtcgttctgccgcgcgtcatgatcgtcgataccgtcccgaaatggccggcgggccggttacggcccgccgtcgcagtcgtcctgtcagccacgcgcaaccctcaccgcaggcccctgtcccagtgccccggccagggcctcgacctcgcggtcgaagctggttgccgcctggcgcaggctggcagagaagccggcctccgccaggaccgcatcggtcgcggcgtcgtcaccatcgatcagccgggcgagcagcaccagatcgggttcgatccaggccagcgtatcgtccgcggtctggccgcgaagatccgccccctgctgcccctcgccttccgggacctcgccctgctcggtctcaccctcggcaggtgccggcggctgcggcagtgcctcggccgggaagacgaccggcggacccgcctcggccggcaccggttgcccctcgcgcaccacattgatcatcaccttgtcgaccgatacgccgctcgccgcaatagcgtccagccggcgcagcagatcgccgaagaaggtggtgaccagttcgctgtcgaaggtggtgtcgatacccagatccgcgatcaggctgcgggccatcagcgccgtgtagtcgcccaggatccgctcgcgctcgaagcccgaagccgcacgatgggcctcgcgggcatattcgacgatcgcggtctcatagaagcgatcgcgcaacaccagttcgatccggccgaacgtcgactcggccagggtgacgtccggcgggatcgggatgaccaccgccaccggcacctcgttctcttccggcaggacgtcgaccgggatcggctcgatcgcaacggtcagggtgaccgacccgctttccagcgcgccgtcgcctgccgtcacggtcaccgtctcgacgaagtccggccggccgggcgcaccggctgcggcggtctcgacactcggtcgatagaccagccggcccgcggcgatgtcggcggccgagaccgtgaagcccgcactctgcgccacgccgttcagatagaaggtgccgtagcgggtctcgccgtcgaagcggaagaccagcgcatcgccatccggatccgtcgcctccagcaccgacccgtcgatcaccacctggccggtggcaaggatccggacggtcccgggttcggccagaaccggtgcctcgttgacgtcggtgaccgcgatgtcgaccacgctgcgggcggtgatgccgccggcattggtgacgctgatcaccagccggaccgagccctcggcctcgtggtcaagagacacgccgtccttcagcttcagcgtctggacgccatccacctcgacgatctcgaagcgatcgtcgtcgaccgtccaggtgacctcgccgggcacgccggtatcgtcgaccgagacctggccgatgatgccgccggccgcgttctcggccacgctgccgccatccagcaccggcgcgctcgggctctcgtccacatcgccgaccgtgatggtcacgctgcggcttgcggtcagcccgcccgcatcggtggcggtgaggacaagatcgatggtgccgtcggtctcgtagtcgagcgacacgccgtccttcagcttcaggaccagcgcaccatcgacctcgaccacctcgaagcgggcatcgtcgaccgtgacggtgacggtgtcgcccagatcgggatcgtcgaccgagacgccgccgaccacgccgccgggctcgttctcaccgacccgatcgtcgagcagcaccggcgccgagggggcctcgttcacgtcgccgaccgtgatcaccacggtcgtgctggtggcaaggccggtggcgtcggtcgcggtcagcaccagcgtcacggtcggctcgccctcgtgatcgagcgcaaggccgtccttcagcttcagctggccgtcgacgatctcgaagcgggcatcgtcgacggtgatgaccggcggctcgcccacatccggatcgctggccgaaaccgtgccgatcaccgcgccgggggcattctcggccaccgtcgcgccgtccagcaccggcgccgtcggcgcctcggccacgtcggtgaccaggatctcgaccgtccggctggtggagagaccgccgccatcggtgacggtgagcgtcagcgtcaccccaagcccggcctcgtggtcgagcgagacaccgtccttcagcttcagaaccagcgcgccgtcgcgttccaccacctcaaagcgggcatcgtcgaccgagacttccaggctgccgaaatcgctcgccgccgcatccgggtcgctgacggtgatggtgccgaccaccgcccccggcgcgttctcggcgacggtgcggttgtcgatcaccggcaccgccggcgcctcgttcacgtcgccgaccgcgatcaccaccgcggcgctgcggctgccctcgatggtggtcgccgtgatcaccagcgtgatccggtcggccgcctcgtggtcgagggagaccccgtccttcagcttcagcaccgcctggccgtcgatctcgacgatctcgaaccgggcgtcgttcaccgacagcgtgacctcgacccccggatcgacgtcttccaggaagcccaccgcgccgacgatgccgccctgggtgttctcgtcgacccggccatcggccagaaccggcaccggcggggtggcatcggcccgcacggtgacggtgatcgccgtggcggccgaaagcccgccgcggtcggtgaccgtcaccaccagatcgacgctcgccgtatcgccggcgtcgagcgtgacgccgtccttcagcttcagcacgccgtccacgacctcgaagcgggcatcatccaccgtataggtcagcgcgtcgccccggtccggatcgccggccgtcacccggccgaccaccgcaccggcctcgccgccctgcaccgcatcccccgccaccgcgggcgcggtcggcgcctcgttgacgttggtcacggcgagggtgatcaggctggtggtggcaaggccgtcgccgtcggttgcagtcagcaccagcgtcaccgagggttcggcctcgtgatcgagcgcgataccgtccttcagcttcagctggccgtcgacgatctcaaaccgcgcatcgtcgaccgcatagctcagcgcatcgccgtcggggtcggtcgccgtaaccgtaccgatcacggccccggccgcattctcggccaccgtgctgcccgagaccaccggcgccgccggggcctcgttcacatcggtgacggtgatcgtcacgctgcgggtggccgtcagcccgcccgcatcggtgacggtgatcaccagatcgacgacaggctccgcctcgtgatcgagggtgacgccgtccttcagcttcagcacgccgcccacgatttcgaaccgggcatcgtccacggcatagctcgcccgatcgcccgcatccggatcggtggtcgtcacccggccgatcacgccgccggcagcattctcggcgaccgtgtcacccgccagcaccggcgccgccggaggcctcgttcacattggtgacccggatggtgatcggggcgtcgaggctgtggccttcgatatcggtcgaggtgatgaccagatcgatggtggccgccgcctcgtggtcgagcgcgataccgtccttcagcttcagcacgaagctgccatcggcctcgacgatctcgaaccgggcatcatcgaccgtgaagctgccgccctcggggtcgggcagcgtcccgatcacggccccggccgcgttctcggcgaccgtgctgccggtcagcaccggcactaccggctgcatgccgtcatcgaccacggtgatggtcacggtcagactgctggtcaggccccccgcatcctgcgcggtgatgaccagatcgaccgtgggttcggtctcgaagtcgagggcgacgccatccttcagcttcagctgaccgtcgacgatctcgaaccgggcatcgtcgacgctgaaggtcagcgcatcgccgtccggatcgctggccgagatagtgccgatcaccgcccccggctggttctcacccaccaggctggccgagagcaccggctgcgccggggcctcgttgacatccgtcacggtcaccacgaccacccgggtggccgagaggcccccggcatcggttgcagtcagcaccagcgcgaccgagggttcggcctcgtgatcgagcgcgatgccgtccttcagcttcagctggccgtcgacgatctcgaaccgggcgtcgtcgaccgtgaaggtcagcgcgtcgccgtcgggatcgccggccgtcacgctgccgatcacggccccggccgcattctcggcaaccgagctgcccgagaccaccggcgccgccggggcctcgttcacgtcggtgacggtgatggtcacgctgcgggtggcggtcaggccgccgccgtcggtgacggtgatcaccagatcgacgacgggctccgcctcatggtcgagcgcgacgccatccttcagcttcagcacgccgccgacgatctcgaaccgggcatcgtcgacaccataggtcagacgaccattgccggtgtcggccccatccggatcggtggcggtcacccgaccgatcacgccgccggcagcattctcggcaaccgtgtcgccatccagcaccggcgcggccggggcctcgtcgacatccagcacccgcaccagcaccagggcggataccgtgccgccatcggcaccgctggcggtgatacgaagcgtgatctccgccgccgcctcgtggtcgagggcgatgccgtccttcagcttcagtgtccaggtgccgtccagctcgacgacctcgaagcgggcatcgtcgaccgtgtagctggcccctgccacatccggcagggtaccgaccacggcgccttccgcattctcgggcaccgtggtgccgtcgagcacgggcgtcggcggaacgataccgtcgtcgatcacaccgatggtgacggtggtggacaccgacaccgcctcgcggtcggtgaccgtcagcaccagcgtcaccgtgggctcggtctcgtagtcgagcgagacaccatccttcagcttcagctggccgtcgacgatctcgaacctgtcgtcgtcgaccgtgaaggtcagctcgtcatcgacatcctgatcggtggcggtgaccgtgccgatcacggcaccggcctggttctcgggcaccgaactgccgtccagcaccggcgccgtcggggcgtcgttgccgtccagcacctggaggacataggtttcggaagccgagaagccgttggccgcggtcgccgtgatcacgacgctcaccgaaccttcggtctcgtagtccagcgacaccccgtccttcagcttcagcacgccgcccacgacctcgaagcggtcgtcatcgacggtgaaagtcaggcccttgccgtccggatcatccgcggtgaccgtgccgatcgccacgcccggctcgttctcggggatgtcgccaccctccagaaccggcgtggtcggcgcttccggcacatcggtgaccgtcagccgcaccgcggtcgaggcagtgagcccgcccttgtcggtgacggtgatcaccaggtcgacgaagggctcgccctcgtggtccagggtctcacccgccaccagtcgcagctcaccgtcgacgatctcgaagcgcggatcgttgaccgagaaggtcagggtctcggccgcatccggatccgtcgcggtcacccggccgatcacctgggcatcctcgggcaccacggtcccggagagcacaggggccgagggcgcctcgttcacatcgccgatcgcgatggtcacgaccgacgagcgggtgccctcgatggtggtggtggtcagcagcagggtgacccggtcggccgcctcgtgatcgagcgccacaccgtccttcagcttcagcacgaagctgccatcctgtgtgacgacctcgaagcgggcatcgtcaaccgcaacggtgacgtccacacccggatcaacatcctcgaggaagccgatcacgccgaccacggcacccggcgcattctcgggcacccggccatcggcgatcaccggcaccggcggggtggtgtcggggcgcacggtcagatcgacggtggtcgaggccgaaagcccgccaccgtcggtgaccgtaatcaccaggctcaccgaagcctcgtcggccgcggagatgaccacgccatccttcagcttcagcacgccgccgacgatctcgaaccgcgcatcgtcgaccgtataggtcagccggccgttggcggtgagcggatcatccggatcgctcgccgacacccggccgacgatcgcaccttccgaaccgccctgcaccgcatcgccggtcaccaccggcaccgtcggcgcctcgttcacatcgccgaccgccagcgtgacgatcatcgccgtcgccagaccgcccggatcgcgggcagtgaccacgagggtcacggtcgggtcgctctcatggtcgagcgcgatgccgtccttcagcttcagggtctggacaccgtcgatatcgacgatctcgaagcgactgtcgtcgaccgtataggtcagcgcatcgccatccggatcggtgcaggtcaccgcaccgatcacggcaccgggcgcgttctcggccacctcggtgcctgaaaccgacggcgtcgccggggcctcgttcacatccgaaaccgtgatggtcaccgtgcggctggcggtgagcccgccgccatcggtgacggtcagcaccagatcgaccgtcgccgcggcctcgtggtcgagggacacgccgtccttcagcttcagcacgccgcccacgatctcgaaccgggcatcgtcgaccgtataggtcagccggccattggccgtgctgccgctgtcgggatcgcttgcggtcacccggccgaccaccgcgccggcggcattctcggcgaccgtgccgccatcgagcgcaggcgcgcccggcacctcgttcacatcgctgacggtgatcgtcaccgtgctcgacaacgtggtgtcgtcgaccgcggtcgaggtgatgaccaggcgaaccgaggcctcggcctcgtggtcgagggacacgccatccttcagcttcagcgtccaggtgccgtccaggtcgacgatctcgaaccgggcatcatccaccgagaagctgccgccattcgggtccggcagggtgccgatcacaccgccggccagattctcggccaccgtccgcccggtcagcaccggcacggtcggggtgacgccgtcgtcgagcacggtgatcgtcaccgtggccgatgccgacagcccgtccggatcggtcgcggtgatcaccagatcgatcgatgcctcggtctcggcatccaggctgatgccgtccttcagcttcagcacgccatcgacgatttcgaaccgggcatcgtcgaccgtgtaggtcagcgcgtcatcatcgggatcggtcgctgtcaccatgccgatgccggcgccggccacgccctccggcaccaccgacccgtcgagggtgggggcagccggggcctcgttcacatcggccaccgccaccgtcaccagccgcgaggcggtgagaccgcctgcgtcggttgcggtgacgaccagcgtcagctcggcggtcgtctcgtggtcgagcgacacgccgtccttcagcttcagcacgcccgagacgatttcgaaccgggcgtcgtcgaccgtgaaggtcagcgtgtcgccggcatccggatcggtgccgctgacggtgccgaccaccgcgcccgccacattctcggtgacggtcgtgcccgagaccaccggctgggccggggcttcgttcacatcggtcacggtgatggtaaccgtgcggctggtggtaagcccgccgccatcgatgacggtcagcaccagatcgaccgagggctcggcctcgtgatcgagggtgatgccgtctttcagcttcagcacgcccgagacgatctcgaagcgcgtatcgtcgaccgtataggtcagctgcccggcagaggttgccgcatcatcgggatcaaccgcgctcacccggccgaccaccgcaccggcggtgttctcgggcaggctggagccgccgacggtcggtgccgccggcgcctcgttgacgtcggtaacccggatcagcacctccgcggtcgcggtgtcgccctcgctgacctctgaggtgatgcggagcgtgatgctcgcctcggcctcgtggtcgaccgagaccccatccttcagcttcagcgtcggcacgccgtcgcgatcgatgatctcgaagcgggcatcgtcgaccgtgtaggagaccccggccccgcccggcagcgtgccgatcagggcgccggcggcattctcggccaccacgccgccgctcagcaccggcagcggtgcggtcacgccgtcgtcgaccaccgtcacctgcaccgtggtgctggtggcgaggccgcccgcatcggtggcggtgatcaccagatcgaccgagggctcggtctcgaagtcgagagagacgccggccttcagcttcagcacgtcgcccacgatctcgaagcgggcatcgtcgaccgtgtaggtgagcgtgtcgccggcatcagggtcgccggccgacaccacgccgatcaccgccccgggcaggttctcgaccaccgagttaccgtcgagcgccggtgccgtcggtgcctcgttcacatcgccgaccgtgatggtcacgctgcggctggcggcaagcccggccgcatcggtcgcggtgatggtcagttgcaccgacgcctcgacctcgtgatcgagcgcgatgccgtccttcagcttgagcgtgccgtcgacgatctcgaagcggctgtcgtcgaccgagaaggtcagcatgtcacccgcatccggatcgctgccggtcaccgtgccgatcacggcgccggccgcattctcggccaccgtcgcacccgagagcaccggctgggccggcgcctcgttcacatcggtcacggtgatggtaaccgtgcggctggcggtgagcccgccgccatcggtgacggtcagcaccaggtcgatgctcgccgcagcctcgtggtcgagggacacaccgtccttcagcttcagcacgccgcccacgatctcgaaccgggcgtcgtcgacggtgaaggtcttctggccgaagctcaccgtcggatcgtccggatcggtcgcggtcacccggccgatcgtggcacccgccgcattctcggccacggtcgcggcatcgagcaccggctgggccggggcctcgttgacatcggtgacacggatggtgacgtcaccctcggccgtgccgccatcgccgccggtggcggtcaggcgtaccacgacctcggccgccgcttcgtgatcgagcgagatgccgtccttgagcttcagaagctggacgccgtcgcgctcgacgatctcgaagcgggcatcgtcaaccgcatagctgccgtcgccgatatcaggcagcgagccgatgatcgccccggccgcattctcggccacgatgccgccatccagcaccggggtcggcgcgacgatgccgtcatcgacgacggtgatggtcacggcacgggtggcggtgagcccgtccccgtcggtggcagtgatcaccagattgacactcggctcggtctcgtagtcgagcgcgatgccgtccttcagtttcaggctgccgtcgacgatctcgaaccgatcgtcgtcgaccgtgaaggtgatgctgtcgccatcatccggatcagacccggtcacagtgccgatcacggcgccagccgcattctcggccaccgtcgagcccgagagcaccggttgcgccggggcctcgttcacgtcggtgacggtgatcgtcacgctgcgcgtggccgtcaggccatccgcatccgtcgcggtgatcaccagatcgaccgaggcttccgtctcatagtcgaggctgatgctgtccttcagcttcaggctgccgtcgacgatctcgaaccggtcgtcgtcgaccgtgaaggtcagcgtatcgccggcatcggggtcggacccggtcacggtcccgatctcggcaccggccgcattctcagccaccgtcgcgccggtcagaaccggctgggtcggggtctcgttcacattgtcgacggcgatcaccacgacattggaacggctgccctcgatggtggtggcggtgatcaccagcgtgaccgaggcctccgcctcgcggtcgaggctgataccgtccttcagcttcagggtcggcacaccatcgacgtcgacgatctcgaagcgggcatcatcgaccgtcagagacacatccacacccggatcgaccggatcggtgaaccgcaccggcccgatcaccccgccgggggtgttttcagagacgatgccatcgggcagggccggcaccggcggcgtggcatcgggcagcacggtcagcacgaccgtctgcgtcgaggcgaggccaagcccgtcggttgcggtgatgaccaggctgacggtcggctcgtcacccaccgacaggctttcgcccgccttcagcttcagcatgtcgccgacgatctcgaaccggctgtcgtcgacgttgaaggtcagacggccttcctgcgtggtcgcatcatccggatcggtcgcggtcacgcggccgacgatcgcgccggcgtcaccgccctggacggtgtcggaggacagcaccggcgtggtcggggcctcgttgacgtcggtcaccgtgaccagcatcacgcgctcggccgaaaggccgccggtatcggtggcggtgatcaccagcgccacggagcccgcggcctcgtgatccagcgacacgccgtccttcagcttcagcaccatgtcgcccgcgacatcgacgatctcgaagcgatcgtcgttcacggtgtaggtgaggtcgtcgccggcatccgggtcggtggaggtgacggtgccaatcacggcacccgccgcgttctccgccaccgtcgcacccgacaccaccggggtggagggggtttcgttcaggtcggtgacattgatcgtggcaaccaggctgtcgctcagaccgccgccatcggtgacctggatgttgagggtcaccgtcgcctcggtctcgtgatcgaggctgacgccgtccttcagtttcagaaggccgtccacgatctcgaagcgggcatcgtcgaccgtgaaggtcttctggccgaagctggtcgaggcatcatccggatcggtcgcgctcacccggccgatcaccgcaccttcggcattctcggccacgctgtcgttgtcgagcaccggtgcgccgacctgctcattggcatcggcgaccgtgatcacgaaggtgccggtcttggcatcgtcgttgacgtagatcgaggtgatctgcagcgtcaccgtcggctcggcctcgtggtcgagcgaaatgccgtccttgagcttcagggtcggcgtcatgccgatgaagaccacttcgaagcgggcatcatcgacgatatagccgttgagcgtcgccaccggcagggtgccgatcacggccccggcctcgttctcggtgacggtggtgttgctgagaacaggcgtggccgcactgttggtgtcgtcgagcaccttgaccgaaaccgtgctctgggtctggagccccgccacatcggtggcggtgatcaccagatcgaccgaggtcgcggcctcgtaatcgagatactcgccatccttcagcttcagctggccgccgacgatctcaaaacgggcgtcgtcgacggtataggtgacgctgtccccgtcatccgggtcgccgccgctgacattgccgatcaccgcgccgatgtcgttctcgacgaccacattgccatcgagcaccggggcattcggcgcttcgttgacatcggtcaccgtcagcatcagcagccgggtggcggtcagaccgccgccatcggttgcggtcagcaccagggtgatggtcggctcggactcgtgatcgagcgagacgccgtccttcagcttcagctggccatcgacgatttcgaaccgggcatcgtcgaccgacaggccggccaggtcgtcgacatccggatcggaggtcgtgaccgtgccgatcgccgcgccggcgtcattctcggcaaccgtcccgtcgccggtgaacaccggcaccgagggcgcctcgttgacgttggagaccgtcacggtcaccgtccgctctgcggtcagcccgtcgccatcggtcaccgtcaccacaaggtcgatggtcgccgccgcctcgcgatccaggctcacgccgtccttcagcttcaggacattgcccaccacctcgaaccggctgtcgtcgacggtataggtcagggtgtcgccggcatcgggatcggtggaggcgagggtgccgacggcaacccccgcggcattctcggccacggtgccgccggtcagcaccggctgcgacggcgcctcgttcacattcgcgacccggatcagcacatcggcggtgcgggtctcgttatccgcatcggtcgcggtgatcgtgaccgtcacctcggcggcggcctcgcggtcgagtgagatgccgtccttcagcttcagcacggtccggccgtcgctttcgacgatctcgaagcgggtgtcgtcgacggtatagctgatgccgtcgagcgtcggcagggtgccgaccaccgcaccggtatcgttctcggtgacattgccgccggtcagcaccggcagcggcgtgatcacgccgtcgtcgcggatggtgatggtcacattggtggcgttggaggcgttgtccgggtcggtgaccgtcagcaccagatcgacggtcggctcggtttcgtagtcgaggctgaccccctccttgagccggagcagctggacgccgtcgacgctgacgatctcgaagcgcgcatcatcgaccgtataggtcagcgtatcgccatcggcatcggtcgcggtcacgcggccgatgaccgcgccggcgtcgttctcgtccacctcgtcattgtcgagaacgggtgccgtcggctgatcgttcacggcagagaccgagagcgtcaccgtggccgtgtcggtccgcgctccgccagagcccgtgttgccgccgtcatcgatatcgacggtcagggtcacgtcgccattggcgttcgccacaggcgtgaaggtcagcgcaccacccgagaggaaggcattgatgtcggtaacggtgccggtcagcgtcagcgccgtcgccgtcccgccaaccgtcacatcggccgtgctggtcgcggccagttcaccctcacccaccgtgaaggtcaccgtcacctcgccggtgctggcatccacatccgaaatcgaaatgccggtcagcgcggtttcggtgtcttcggtcacgtcgatcgaggccggcgccgtcagctccggcgcatcattcacggccgtcacctccaacgtcaccgtcgcggtgtcggtctgcgacccgcccgagccggtgttgccgccgtcgtcgacggtcacggtcagggtgacatcggcagtcgcattcgctgccgtggtgtagccgacgccgctggcggcgatgaaggcattgatcgcggtaaccgtgccggtcagcgtcaggctggtcgccgtaccgcccaccacaacacccgaaccgctggtcgcggacagggtcccggtggcgacctccagcgtgacggtcacatcgttgctgccggcatcggcatcactgatcgagataccagtcagcgcggttgcgacgtcctcggtcacgctgatcgagcccggcgccgtgatctccggcgcgtcgttcaccgccgacaccgacagcgtcaccgtagcggtgtcggtcttggcgccaccggagccggtgttgccgccgtcatccacatcgatcgtcagcgtcacatcgccgctggcttccgcatccggcgtgaaggtcagcccgctgcccgtgatgaagtcgttgatatccgcaaccgtaccggtcagcgtcagcgccgtcgccgtgccgccaaccgtcacatcggccgtgctggtcgcggcaagcgtgccctcacccaccgtgaaggtcaccgtcacatcgctgctgcccgcatcggcatcagagatcgagatgccggtcagcgcggtttccgtgtcttcggtgacgtcgatcgaagccggcgccgtcagctccggcgcgtcgttcaccgccgaaatcgtgatcgcgaaggtccgaccggtgaccgacagattggtcgtgtccttcaccgagaagccgaagctgcccgacgccgtctcagaaccgtcgtgatcataagtcacgagcccgtcgtcgatatccttctgggtgaaggtatcgcccacttcaagcgcggtgccgtccagcttcagcgtgcccgacgccggcgccgtggtcagcgtgtaggtgacgtccgccggatccgtgtcctcgctgtcggaagacgacagcatcgccgaagtgatcgtggtcgaaccgccctcgtccaccgtcgtgccggtgttggtgtcgaccttcggcgcggcgttgacctcgatcgtgcgctcgaacgccacactcgtctgcgtatccgtgtcgccgctgtcgtcggtggcgacgatcgacaccacgcggtcgccgcccggcatcgtcgacgacgcgccggtgtagaggaaggccgccccttgcagcaccgtctggtagtcggcgacagacgccgtgcccgaaagcgtcagcgtgcccgccgccgaattgtagttatagctgatgccatggtcgttggcgtaattcgccgccggcacgaacaggcccatatagtccgacgtgccgcccgggcgggtggtcagggtcagcacaacgccggtcaacatggtcgagtcgacgtcgctgagcgccgcagagccgacaaccgccacggccgcaccaccggccatatagaccggcgaggacgacaggtcggtcacgacgggggaatcattcgtggcctggatgttcatggtagtgacgtgcgtgccggtcagcgcgccgcccgagccctgggcgccggtattgccgtcatcgaccgaccagagcagatcgacagaggagggcggcgtattgttcgccgtggcatagccgatctgcttcgccgcttcgttcaccagatcataggtggcgtcggcattgagcgtgaggaccagtgtcccgccggcattggtcgtgacggtcccgatcacggtgccgccgaccgtcagatcctcaccctcggtcagatcacccagcgtgccgccgctgatcgctccgaacaggtcgtcggcatcggccccgccatcgcgggtgatggtgatgaccatgccgtcatgattgtcgaccagccacagctcgggatcgtaaatgtcgatctcgggatcgatggcggtgaagccgccatcctcgacatgggtcggatccatgttgaagccgatgacgggcgtaccatcggcggtgaagcgcgccgcgaagatctcatcgccgccgcagccgcaccccagatagctgccgcccagcagcagatcaccattgtcgtcgatggtgagcgacgagatcgtgaagctgcgcagatcgtcgccgaaggtgacttcgccattggtcccgaagctggtgtccagctgcccgtcggcgccgatcttgatgatcgaggccgtagcggacgggatgcccccgtcgatcgtcatatgggtgccgacgaagaccatgctgccatcggccagcagggtcgcatcggtggtcagattgccggtgaagaccaggctgccgccgctgccgaagctgccatccaccgacccgtcatcagtcaggcgcacaagcgtggtgaccggcagtccggtatccgcatcggtatggatgttcacgacgaccatgccgccggcggactgcggcagaacgatcatactgctctcgaagatatcgggatcgtcgatcgtgacggtgccgctgccgccgaagccggtatccagcgtgccatcggcgttgtagcgctgaagtatggcaccatcgtcattggcgccggcaacgacgatcttgccgtcgtcctggaccgcgacgctcagcagcgtctcgttgccgccaagatcgatcgcaaccggcgcaccgccgttgaacgcggcgtcgatgctgccatcggcaagcagccggtacagcaggccatcggtggtgccggcggcgccggtgaaattcatgcccgccaccaggatgcggccggtgtcgtccaccgtcaccttgaacagcgagaattccaccccggcgtcgttgaagaggacgacgccgctcgtgccgaagccctcatccatcgagccgtcgtcgttcaggctgatcagcacggcggcggtggtcccaccggacgggctgaccgtgccagagatcaacagcttgccattgctctgcagcagggcggtcacgggcgtgaacgtgccgccgccgtccagggtgacgacgccattggtgccgaagctggtgtcgagcttgccgtcggcgtcatagcgcgcgaccacgatcatattcggcgcgacatcggtatcgacgccgaactggtagtaactgccgtcaggcagggcgacgatcccgccgacgctgtccatgtccccgggcccgtcgacgacgaccacaccatcgggcatggtggtcacatcgggcgcatcgttgacggcgtcgactgtgatcgtcaccgtctcgctggcggtttcagaggcgccgccgctgttgcccagatcgtcgatatcgacggtcagggtgacatcaccggtatcgtcggtatcggtctggaaggtgacgccctgggcggcgatgaaggcattgatgtcggcgatggtgcccgacagcatgatcgccttggtgccgtcggtgaccgtcactcccgccccgctggtggcggtgatcgtgcccttgtcgacgctcagcgtcacctcgaccgtgccactgccggcatcggcatcggcaaaggaaatgccggtgatcgccgtggccgtgtcttcggtgaccgtgatcgtggcaccagccggcacggtgatcaccggcgcgtcgttgacggtggtgatggcgacggtggtcgtcagcgtgccctcggccgcaccgccggtcccctgcgtgccgctattgccgtcattcaccgtccagaccagatcgaccgaggccgctggcgcgtcgctggaattggtataggcgatctggcgcagcgcctcgttcaccagcgcacgggtcgctgcggcattgagcgacagcaccagcgtgccggccgaattggtgaccaccgtgccgatggtggtgccggagacgacaagggcatcgccttcggtcagggcatcgagcgtgccgccatcggctgccgagaactgatcctggccgtcggcgccgccatcgcgcgtgaggctgacggtgaaaccgtcgagcgtgtcggcatcgcccagatcgacatcgtcgaccgcaatcgtcggcgcaatgacgaccgcagcgccgttttcggtataggccgccgggtcggcatcgaagaccggctggccggtcgcgtcatagcgggcgaagtagatatcggccggctgcaatgccgagtcgtaatggacgccgcccagcaggatttcgccggtgtcggcgtcgatccggaccgaggtgtgattgagcgggaattcggtgccgccgatcgtgaacccgccatcccggccgaaaccggcatcgagcacgccatcggcggtaaagcgctgaaccgtcgtcgaaatatccgcggcgaaggagatggtgccgacgacgatgatgccgccatccggggcgaaggcgaaggagacggtgtgcgccgcctcccccgtcacggcaccgttcacaccaaagccggtatccagcgcaccatcggcggtcagccgccagatcaccggcacctgctggccggggaggccggaatcctcggtcgccgacgccaccagaatgctgccatcggcctgcacgctgaccgcctgggcgccggtgccgccgccgaggagatcggtatcgatgatcagataaccgccggttccgaagctggtatccagcgtgcgatcggcattgtggcggtagacgatcagatcgcggccctgggccgccagcgtcacgaccttgccgtcgggctggatgaccgaatcgagggcctgctcgctgcccggaatgctggcgccgacattgaacacgccgtccgcggtgccgtcggcggtgaagcggaatacgacggtgctggtatcgcccgaggtgggcgtcagcgtcgccgtgacatagatccggtcgctgccgtcgatttcgatatcgaccggaccgaagctcgatgaggcctggatgacggtgatcgggaagcccgacaccacgctgccatcggtcgcaagacgcgtcaccaccagcgagctgtcgaagaccgcgcggccggcaatgatcagctcgcccgagtccagcaccttcacggcactcggaaccgtgccggtgaaataggccgcaccatccgtgccatagctggtatcgatgctgccatcggcgttgtagcgatagaccagcacattctggtacgcatccccaccggtggtgcggctgctgaccacataatggccgccgcccggcgcatccagcatccagatcgggttggagatcggctcgggcatgccgaccacatcgacgccgttgtcgatggtgtagacatccggcgcgtcgttgaccggatcaacggtcacggtgatcgtttcggcatcggtgcccggcagggccgcgtcctggtcgctgacgctgaccgagagatcgaccgtaccggtgacgttcacccccggccggtaggtcacattgccgccggaaatgaaggcgttgatatcggcccggctgccggtgaggatcagggtctggccgccggccgcaacggtgacgtcggcggtgccggtgacggtgaacgaaccgcccggggcggtgatcgtcagcacgtaatcctggccgagatcgtcggtgtcggcgatcgaaatgccggtgatctgaagatcggtgtcctcgttcacggtcagcgagcccggcacggtcagcaccggtgcctcgttcacgaccgtcacctccatgctgccggtggcgagcgccgaggaataggcgctggagctgccggtgatggtggtgtcggcggtgccgcggatggaaccgctggtggcggtgccgatcgtctggtcccaggcgcggaacgagatggtcgcggtctcggccgtgttaccggccgggtcgtagcggagctgggcatccgccgccagcagaagcgaggcattcaccgacacggtgccgaccgcataccagttcgtgccgtcggtcgaatattcccagctgccggtgccggtcagcgcggtgatcgcgatacccgaagacgggctggcatcgacgtcgccatagccggcatcggtgagcaggtcactgacggtcaccggcgtcgacacgtcgttgcggtcaatcgggtccagcgtgacatcggtgttcgacagggtcggcgcgtcgttgatctgggtgacgaccatccccgcacgggaatcttccacggaataggcggtgctgccgccggtgctggacgcatcccccgtccggagcgtggccccgctggtggccgtgcccgaggtctggtcccagccccggaaggtcagcgacgccgggccgccgcggttgttgtcggggatgaagcggaactgggtggtcgctgcgaacagcagggccgcagcgtcggatgccgtcgtgcccagcccgtaccagttggtgccgtcggttgtgtactgccaggcgccgttgccgacgataccggtgatcgcgatgcccgaaaccgcaccgctgtcgggatcggcataattcacatcggtcagccagtcgctgaccgaataggtcgtcgaaggagtgttctcgttggtggtggtcagcgcgacctccgaaccgtcgatggtcggcgcgtcgttcaccgcagagaccgccagcgtcaccgtggccgtgtcggtcttcgccccaccggagccggtattgccgccgtcgtcgacatcgacggtcagggtcacgttgccggtggcgtcggcggcgggcgtgaaggtcagcgcgctggccgcgatgaaggcattgatgtcggccaccgagccggtcagcgtcagcgccgtcgccgtcccgccaaccgtcacatcggccgtgctggtcgcggccagttcaccctcacccaccgtgaaggtcaccgtcacctcgccggtgccggcatcggcatccgaaatcgaaatgccggtcagcgcggtttcggtgtcttcggtgacgtcgatcgaggccggcgccgtgatctccggcgcgtcgttcaccgccgtgatcgtgatcgcgaagctctggctgctgagcgtcagattggtcgtgtccttgaccgagaagccgaagccgcccgacgccccttccgaaccgtcgtgatcataagtcacaagcccgtcgtcgatatccttctgggtgaaggtatcgcccacttcaagcgcggtgccgtccagcttcagcgtgcccgacgccggcgccgtggtcagcgtgtaggtgacatccgccggatccgtatcctcgctgtcggaagacgacagcatcgccgaggtgatcgtggtcgaccgccctcgtccaccgtcgtgccggtattggtgtcgaccttcggcgcggcgttgacctcgatcgtgcgctcgaacgccacactcgtctgcgtatccgtgtcgccgctgtcgtcggtggcaacgatcgacaccacacggtcgccgcccggcatcgtcgacgacgcgccggtgtagaggaaggcgagcccctgaagcaccgtctggtagtcggcaaccgaggccgtgcccgagagcgtgtacgtgccagcacctccattgaaggtgtagctgatgccatggtcgttggcgtaattcgccgcaggcacgaacaggcccatatagtcagacgcaccaccaggacgggtggtgaaggtcaccacgacactggtcagattggccgaatcgacatcgctcagcgccgcggagccgacaaccgccacagccgcaccgcccgctgtatagaccggcgagtccgacaggtcggtcacgaccggcgcgtcgttcaccgcggtcacgtcgagcgtgatcgtggcactgtcggtcttcgcaccgccggggccggtattgccgccgtcatcgacggtcacggtcagcgtcacatcggcggtcgcattcgccgccgtggtgtagccgacgccgctggcggcgatgaaggcattgatcgcggtcaccgtgccggtcagcgtcagactggtcgccgtgccgccgaccacaacacccgacccgctggtcgcggacagggtcccggtgaggacgtccagcgtgaccgtcacatcgccagtcccggcatcgacatcactgatcgagatgccggtgagcgcggtttccacgtcttcggtcacatcgatcgtggccggtgccgtaatctccggcgcgtcgttcaccgccgacaccgccagcgtcaccgtcgccgtgtcggtcttcgccccgccggaccccgtattgccgccatcatcgatatcgacggtcagggtcacgtcgccgctggcattggcgaccggcgtgaaggtcagcgcactgcccgtgatgaaggcgttgatgtcggccaccgtgccggtcagcgtcagcgcggtcgccgtgccacccaccgtgacgtcggcggtgctggtcgcggccagttcaccctcacccaccgtgaaggtcaccgtcacttcgccggtgccggcatcggcatcactgatcgaaatgccggtgagcgcagtctcggtgtcttcggtcacgtcgatcgacgcaggcgccgtgatttcgggcgcgtcgttcacggccgttacggtgatcgcgaaggtctgactgctgacggtgtggttggtcgtatccgtcaccgagaagccgaagctgcccgacgtggtttccgagccgtcatgctcgtaggtcagcagcccgtcgtcgatgtccttctgggtaaaggtgtcattcaccgacagcgcagtaccgttgcgcttcagcgtgcccgcggccggcgccgtggtcagggtataggtgacatcggccggatcggtgtcttcggtatccgacgacgacagcatcgccgaggtgatggtggtggagccaccctcgtccagcgtcgtgccggtgttggtgtcgaccttcggcggggcatcgacctcgaccgtgcgttcgaaggcggcgctggcctgggtcgcactgtcgccgctgtcatccgtcgcgacgatcgagaccacacggtcgccgccgggcatggaggcagcggcgccggtataggcatagaccacgccccgcagcacggtctgatattgggcgaccgaggccgtgcccgaaagggtcagcgtgcccgtggcgttgttgtaggcgacgttgatgccgtagttacttgcatcgtccgcccccgtggtcgacatggcgatacgatccgacgtcccgcccgggcgggtggtcagggtcaggaccacgctggtcagattgccggagtcgacgtcgacgatcgtagcggattcggccaccgccaccggcgagccgccggcactgaagagcggcgatgccgaagtatcgttcaccaccggcgcatcattcaccggcgtcgtgctgacggtgaaggtatgctgcaccgagtccgaatagtttgcggacgactgcttcagcgtgaaggtcagggtgccggcagtttccccgccgtcatgctggaaggtgacgagcccgtcgtcgatatcctgctgggtaaaggtcccgttggtcgacagcgtgctgccgttgagcgacacggtcagatgactgagcgccgccaccgtatagatcagatccgccccggtggcgtaatcgtcggaggcttccagcatcgcggtggtgatgctgcccgatccgccctccgcaaccgtggtgccggtattggtggcgaccgtcggggtcttgtcgatctcgatcgtcagatcgaaggtgccgacctgatcattggcatcggtgacggtatagcggatggtgcggtcggtcgtatcgacagtggcccccgacgacgtgttcttgtactcgacgttgcggagagcctcctgataggtattgagcgacgccgtgccggtgaaggtcagcgttttggtgtacgtatcatacgagatggtgataccagcataggttcccgcaatgcgcggacgctccgcggtatcgtccgggtcatcgaccagctgcaccgtcgccgatttaatcatcgccgtgtcgtcgatgaggaacaggtccggtgcgaactgcgcatagctgctattgcctgaataggcaccaggggtatagacgaaggtgtcggccgaaatcgccggcggatcgtcgtccaggctggtgacggcgacgccgctgccgatcagcgcgtccgaggtggcgccgtcggcatcggtgacggtgacgcggaggatgcgcgagccggcggcatcgggggtataggccgatccggtattgccccaggtgggggcgtcggaggtggacgaataggtgaccgtccgcagcgccgcctgcatctgcgccacggtgccgctgccggtcagcgtcaggacgaggaagccgccttccattgccaggctggcactatagggcccgggcgaggtgatcgcgagcacgtcgccgtccttggggttggagatccagaccttcgccgaggtgatcaggtcgccgtcgtcgtcggcgaccgtgataccgggcaacgcgacggtcggggcgttgccttcggtccaggacaccgtctgcgagccgccaagcaccggggttgtgtcgttcaccagctcgaccgcaccgatatcgatggcactgcccgaaatgcgggtcgcgccggtctggtcggtggcgggctggccggtgatcgaggcattgccggcatcgatcgccgagctgccggtgcccggcttcatcgtctgggtatagccgccattatccgccagcgcccccagattgggatcggtggtcttgtcggtgccggcgctggtccagccgttattggcaagactgttgccgtaatagatgttccagccgacattggtcgtagtgccgccggtgacgttcacgccccggccggtgttgttggccagaatcgtatggctgacgctgaccgagccgccataggaatcgatggtaccttgataggtggcattcgtcgcgctgttgcccgagaaggtgctgtgcgccacggtaagcgccgaggaattctcgatcgcaccaccataagttgccgaattacccgaaaaggtagagttcaccaccgaggtggtgctgttggtgccgagcatcgcgatcgcaccgccacttcccgaactggcggtattccgatcgaaggtcgagcggacaatctggaggtcgatccgcccagagccgccgctataaatggcaccgccgttgccgttcgtcgcattggctgtgttctgcgtgaaggtgctgtcggtgatgaaggcttcggacgccgtcgccgtgtccgcgaggtcgagagcgccgcccccagtgctgccgcttgtcgcatcgttgcttgtgaaggtcgaccggtcgatcgtggtcgagccgccgccggtccgggcagatattgccccccccgccgcagtcgtgttgttggtaaagctgctatccgctacggaaaaagttatgttgccggaggtatttccctccacgcggatcgcaccaccggcattcgtcgcactgttctgatcgaaactgctgtcagcgacgttcagcgtggcgccggccgcactggtctgatagatcgcaccgccctgggtggtcgcggtgttggtggtgaactggccggtgaccgtgtggatgaaattgccgccggaaatataaatcgcgccaccggcgccgctggtcgcctggttgtcgacgaagctgttggtgccggtcatcgccagctggccgccggccatatagacggcaccgccctccgtggccgtcagattgttcatggtgatgtcggtcagcgtcagcgtgtccgagccggaggcggtgaaattgatgccggcgccgccgcccgaggtcctggtcgcattctcgatctgcagccgcgcaaaggtgaccgtggcatccgtgacggtgaacacgctgccattggtcaggccggccgcatccagcacccgggtggtggtgtcgtccgaacggatcagcacattgtcggtgatggcgctgaagcccgcagagaccgtgagattggcggtgatgtcgatctggtcggtgccgaccgcggtattggcattgatgatcgcggtttccagctgggccgccgtgccggcggtgaaggtcgccatcagcccgtcatagccggcgcgggtgtcttcggtcaccgcgatcgaggtctcgacccggccgatcgaaacctccagatcccagtcgccgaaacggccgccgccattggcggcgacgctgccggtggcatcgtccgaggcggcgacatcggcgccggtcagctctgccagccggcccagaaaggccaggccgtcgctgccaccggcgacatcgcagccataaagcaggatgtcgccatcctcggccaggccggcgccgatcaccgccaggtcgccggcccggtcgtcgatattcctgtccgagagggtcgaagatcccagccagatttcgccgacactgccttcggaaatgatatggacggcatcgaccgcccccgactgttcggccatccagtcggcgatctgttccagcccgtcgcggccggcatccagcaccacgatttcgacgtcgtcggccagacccgccgccagggtctgccagtcggtgacacgggtatcgatgaaggcgacctcgcgacggtcacccgccgccggagccgccgtcacatccgatccgtcatcgccaccctgggcggcggtttcgaccagagccgtgccgtcatgagcatcggccggatggccggcatcggtgcccccgccgtcggcggcggtatctgggtgcagttcctgcgcggcatcctgggccgcctggtcctgcagcgcctctgccgcggtggcgacaccggcggcatcgaacatcatccgtggttcaagcgcctgggccagcgccccccgccgccccggccggcgcggcccgatggtctgacggccggcatgatctccccgacgacgaaagcggcgcatgatacccgtcccccgaaaccccgtgacgaccgggcgacatgatctccacccccggtctgactgtcattcccgcggcgccggcggttcttcgtcacgaagtgccgcatatcgcaacgatacacctgtccagccggacgcagcgtaccttcgtcgggttttcgttaacctagctgaaccttactgacccgaaaagcggctttcggggcgtgcgcccggcgaagcggtgctccagaagattgattcggcgcgtttttcaacgatcccaagcatttgagctatatcaacggccattaacctcgccctgacatcacgggcaagactcctgtcgcaaaccgtgcgacattaatcacgcacggcaaccgccaagcgaaacggcgggaatgcgccgcagatgcatgcaatccaggctggtgcggccaggctggtgcggggctgcatcccgcggggtctgccgccggtcaaccatcgggatgtgggatgttcgagaacttcacctttgaaaccttcgcgccgcatgtcggcaccgaattccatgtgcgcctgccccagggcaatctgccgctgaccctggtttccgcccagcccggtatccaggccatgttgaccggccagcgccgcctgggcttcagcctgatcttccgcggccccccccagatctatctgccggccaacagctacgacatcgcccatccccggctggggctgctgaagatgatgttcatctgcccggtgatcgcgccggtcgatccgtcgaccgggcggccggcgcccggcaatcactacgaagcgattttcaactgaagcctgcatgtgccaccggctgcggcccggccgggcgaccggatcgccacgtcgcgacgacagccatgtcgacaatcaagacggaacaggacgaggacggagaccggatatggatgcacccttcatcgccagcatcgtgacctggatgccggatttcgcccccaagggctgggctttctgccaggggcagatcctgtcgatcgcccagaaccaggcggtattcgcgctgatcggcaccacctatggcggcaacggcaccaccactttcgccctgcccgacctgcgcagccggatcccgatcggcgcgggcaacgggcccggcctgtcgccggtccggctgggcgaagcggccggcgccgaaacccagaccatgaccgatcagaccctgccggcccatacccatttcgccctgccccagctgcacccggtgctgccgctgtcgaccgccccggccacggcgcccgatccggccaccggcgtgctcgccaccggatcggtccgcatcggcagcggccccacagcccagaccttcccggtgtcgaatttcaccaccgcccaggccaatgccgtgctgccggtcaccataccggaggatctgaccgccacccccaccggcaactcccaacccttttcgatcatgcagccctatacggcgctcaacttcatctttgcgatgcagggcatctttccgccgcgcagctgaccggtttccgccgcgcagccgggccggcaccaccccggtcgccatccacgggccaggtcgccatccacatggtctccatcatccataaggtttcggaaagatgaccccctatatcggactctgcatgcattgggcgccggatttcgccccccgcaactgggcctattgcgccaatcagctgatcgcgatcagccagaacaccgcactgttttcgctgatcggcaccacctatggcggtaacggcatccagaccttcgccctgcccgatctgcgcggccgcgccggcctggccgccggccgctcgaccaccggcaccacctatgtcgaaggcgaaatcgccggcaccgaccagaccactttgctgacccccaatatgccggcccatacccatgcggtcagcccggtcaccggcaccctgccggccaccgccacccaggccgataccaacgggccggccaccgggctcgccttcggcatggcgcacaccaccttcgacgataacggcaccgaagtatctgtcccggtcaacgcctatgcagccggcccggccgatgtcacctcggcgacgggggcgtccggcggcacggtcaccttcggggtgaccggccatacggcccagaccccgatcacccagccctatctgggcctgaacatcatcatcgccatgtacggcatcttcccgccgcgcagctgaccggccccgacccgaaaacaggagagaaccgatggacggagtttatctgggggccgtgttcctctgggcgccgagctttgcaccgcgcggctatgccttctgcaacggccaattgctgtcgatcgcgcagaacgacgccctgttcgccctgatcggcaccaccttcggcggcgacggccagaccacctttgccctgcccaacctgatcggccgcacccccctgggcgcgggccaggggcccggcctgtcgaactatgccctgggccagaccggcggcagcgagaccgtcacgctgaccggcaataatctggcccatcacacccacacggtttcggcagatctacaggccgcgattccgatcaccagcaccgatgcaaccgaggccgagcctgcccccaacgtcatcctgggaaccgggaatttcgtgcagaccaatgcgcccggctcccccacccggcccgccaatctgttcgtcgccaagcaggacccggaagcgaccctgccggtgcagatgaacggccaggtcgccgtcggctcgtcgggcatgaacgtcccggtccagatcatgcagcccttcgcggtgctgcaatacatcaccccgctctacggcatttatccgccgcggggctgaccgggcgccacaccgtcgacgacgcatcagggggcacgcggagacgatccacgtgcctctttttttgtccgtcgcgtggccatatggccatattttcggccgcgatctatgtccattatgaaccgtatagtgactggcaagggtgatatggggtgatgcatggctcccccattccccgctccccacccgttaaggaggcgccagttcaatgcccctgccccttggaagcatcctcgcctatgccggcactgccctgccggatggctgggcttttgcccatggccagattctggccatcaccgatcatcccgatctgtcgcggtgatcggcacaacctatggcggtgatggtgtcgaaaccttcgcattgcccgatctgcgtggccggcgctggaccggcgccgatgccgcgacccacccggtcggcggcgctctgggccgatgccgccctggccgacaccgccctggccaatgccgacatcaccggcacggcccatgccggcctttcgggttctgccgtgccgatggccgtttcctggccccggcgatcgagggtgggctggcggttctgccggccggtggcggggtgccggtgccgctgggcgcgccctggctggcggccaccgcgatcatccgcgccaccctctgaccggcaaccccaacgtccccccccccccgccaggccatgccccgcccgacgagaacataacggtttcgtcttgcgccgcaaaaccatcggaacaaggcgcgtacaggcacagaatcatacacgttttcggcgtgttttcggggcaatcggcatcggagcgggggcaagtatcgaacattttatttaaatttccttaaagcgccgggcatcccgtgtgtcagacctcacatgaagctgcacaattcacaagaacaagaaacatgtcgtcgcaccatgctgcattgcaacatttccaaaaggtaaacgcccgcaccgcaaccggccggatgctgagtgacatatcatcgcactgtgatcgacagccgcagactgcaagctcctgggaggcttgattttcctgttatattcctaatatgttcttattttggttgtaattactctcctttaggttgtagtcgattcgtataaagcaggaacatatccggaaaataacggcgtcatatcatggttaacgccgcagccgcatgcggtgatcagaccggcgcagaatgccggggcgatcgaccggccagggccggacgggcccggcttccggtgaatgcggtgcaatattcgcccatcccgccacacctccccgccccaccctttcggtcagggctcgccggggttctcccgcccggatcgccatgccccaccctgggcgcgaacatcatcacccacaccatcgaaacgcgatggacatctccgggcaggcaccctatagtcagggtcgcagcctggtcgtgcgatggcgcggggggatgtatgggacggagggcatgacgcgatgccgccggccccaccgtacaggtttacccgaacttgtgtggtgtagatgcgacaccgacttgagcgcggcggacatgcgtcctgccgcgcttttttcgtcgcccctcggatgtgctgatcagaagccgctttcgcggatggcgacggcgatcacccggcgccacaggctggcggcgaagctttccgccggtgcgtcgatccgcaccatgccccgcagggccagggtctggcctgcgggcagcccggcgccggcatcgggttccagccacacccgatagaccgcgccgcgcggcacggggcggcgttcatggtccagctcggttgcgatcggcccgccattctggctggccagggccggctgatccagggcatccaccgccgtctcggacacggcggtcaccaccaccggcagcgggtcgcgcgcggggtcgtcggtcacgaagcggccgcgggcgccgacctgcagccgcggcagatcctcgcccgacacataggcctcgatccgcccgccctcggcggcgaccaccagccccagcacccgggcgggggacacccacaatcccggcatcagatcggccggcgggtcgcggaagatgccgtcctgcggcgcgcgcaccaccagccgggcgcgctctgccaccagcccgtccagctccgccagccgggcggccagccgcccttccagcacgcccacctcggcggcggtggcggcgctggcggcctggcgctggatcagcctctgggtcacgtccagctccaggcggatcatctcgatcttccggtccagatcggggttgtcgagcaccaccaccggctggccggcggtaacgcgcgcacccgccgccacaggcacctccaccacccgtgccggcgccggcggatgcagccgcgggctggccgatgcctccagcatcgccggcaggccgatattgccctgccagggcacgaaggcgagcccgatcagcagcgccagcaccgccaggctgcgggccatggcccggttcatccgcatctcgtccctcgccttccaccattcgccgatttcgcgcagcgccggcatcgccaggaaccagcacacctccaccgccgccagcatgatgcccagcaccttgaagaaggcgtgatagaccagcacggcgatgcccaggaacaggaagaaccgccagatccaggcgccataggcataaagcagcacggcgtggcgggtgcgcggcggcagcacttccggcggctcgcgccccaggccgaacagggtttcgcgcagatgccagcgggccagcgcgaagccgcggccctgcaggttgcgcacgccgatcagatccgacagcaggtaatagccgtcgaagcgcatcagcgggttcagattgaccagcagggtcatgaaccacgacaccgccgccagaaagaacacggcggatcgcgcgggcccgtcgggcatcagcgtccacagaatggtggcgatggcggcgatgcccagctccaccgccatgcccgccgccccgatgatcagtcgccggtggcgttccggcagccgccaggcatcgctgacatcggtataaagcaccggcatcatcaccagcagggcgacccccatggaatgcacccggcagccgaagcgcttggcggccagggcatggcccatctcgtgcagcaccttggcgatgatcagcgcaataccgaaccagaccgccccttcaagggtcaggaagctggtgaaggtgtgcaggaacacatcccattgccgcccgaccagataaagcgcgatggcgaccagggtgagcagggtaagccccgcccctttggagaacatcatccggccgagcggcgtcagcccgtccagccacatatcggggcggaccagcggcacgcgcacgaacagataattgtgcagcatccaggaaaaggcgctgcgcttcgcggccttgcgctggcgggcatagctgccggtcatccccggctcgtcgcccgcgaccagattgttggcgatcaggaaacgggccagctcgtccacatcgctcagctccagcggcaggcgagaggcggccatggcccgggccagaaccctgtcgggcatgccctgatcccaggcgcccagcagcgccaccgcctggggcgacaggctgtaatagcgcccgcgcgccggatccagaatcgtccagctggggctgccgtccagatcggtggggcccggcagcagcttcagatcctcgcgcagccgcggcaccggtttggcctgctgctggccacccgcgccgcccccgaacgagatggtcggcccccccggcgcgctgccctgcacggatgcgaccatggcctagaacccggtatgctggcgcagcgccgccagcggcctgcggaacagatagaaggccagcggcacatccgcgccatagaccttggcggtgccgcgcagccccacgcggggcagggcctcgccggcgtcctggtccagccgggccttcagctcataggccagaatgccccccggggtctgttccgccgtatagctcatgctggtcatccgcccggccaccggctccagcggccgggcatccaggaacagctgcaccggcgcgcccggctccagccggatcgcctcgcccaccggcagttccacgcggatctcggcccgggccggatcggcgatggtcatgatccgctggccggtctgcaccggccggccgatccagtcgtcggcgcgggtgaagagcacgatgcccgggcgttcggcacggacctccacccgggccaggcgctgttcggcatactccagctccgcctggcgcagccgggcgcgggcttccagcagggcgatctgcgcgccggcatcgcggtcgtcaaaggcgccctggcgcgcgcggcgcagttcggcctcggcgatttccagcgtgcggcgggccactgccacctcggcctgaagattggtcgggtccagccgcagcagcagatcgccggcgtcgacccgctggttgggctgcacctcgatcgcctgcaccaccccgtccagcggcgaggcgacggtcgccgggtcgctggccgacacctcggccggcgccagcacgctctgcggcaccggaatgaaaccggcggcaacggcagccgccaccagccccagcaccagccagcgcggcctgggcagccgccgccggccggcaccacggccggccagcgccagccaggcatgggcataggcatcggccagctgggcggccagaacctgatcggcgggggcgaaaccggtatcgcgggccagccacagccagccgcgcacatggccctcgcgatcggtcagcgggcagagcagcgcatggggggcggccagctccggccaggcctcggccagttcctgtggcagatcggcgggcgtcaccagccgcggcttcagcagctcggcctcgggcgccggcgccggcgtggcgccggccaggggttgtggcgccggtacaggcgcaggcgccgccttcagcgccttcatctggtcgcgatgggcggcggccagatggcccagcacccgttccagccaggtgacatagggcgccgtgcgctccacccccggcacgtccgacagggcgacgggtttcgggcggatcgcgccctcggccagcgccgcctggcgatagggcagcagacggcgggtttcgttgacgatcacatagcgcaggctttgcacatccggcgcgcgccgggcggcacgttccagcgacagcatgatcgagaacaggatcgccgaccggccgcgcgccggatcggctgccgctcccccggctgccgctcccccggctgccgctcccccggctgcaggtgcacccggcttcgccgccgcggcggccagcttctgcagatcgatcttgggcggctgcggccggggatcggcgttcatttcggcgtcccttgcggtttggccccttgcggtttggcctgcggcacgggctcgccttcggcggggccggcaggccgtgccgcagggtcgaagcgcgccgtgccgctcatgcccggcagcagatcggtcggtttcccctcgatcgccgccagcaccggcacggtctgcgacacctgatcgacccgggcaccgatggcagtgacctgcgccttgaccgtgccgccggtctcgtcgaccgcgaaatcgaacggctggccgggcaccagccaggccagccaggtggagggcacgatcagccggatgcgcggcagcccgtccgagacgatcgccagcaaatcgtcaccggcggcgacgccttcggccggctgtgccaggcggcgcaccacccggccggcatagggtgcctcgatccggcagcgctccaccgtggcggaactcagccggatggcggccgaggcctcggccagcttcgcctcggccagctgcacgtccagcacgccgatcgactgaagcttcgccaggctgcgggcattgtcgagtgcggccttggccccggccgcctgggcgcgcgcctgggccagctgggcctcgtagagcgtgcagtcgaaccgcaccagcagggcgcccttggcaaagtccgcgccttcggtcaccggcagatcgacgatccggccggcgatctcggccgaaatcaccgcctccgccgccggctccagcacgccgcgcgcggcctcgggcgacggcgcatcgggacccgtcttcaccggccccggcacgggcgcggccgacaggatcggcggcaactggcggggcgctgcggtggcatcggctcccccacctgacgacaggggcggcagcccggtctgtgccgccgcaagggtggccatcgtcaccagagccgccgccatggcggctccggtcaccacccgacgggcccgcatcgcgttccgaagctgcattccctcaaccgcccctgactgttattccggcgccgtccctgtcgcccgcacgccgggtcagcctacgcctgttggcgcaggcgcgccacgcccctcggccgccatggtcacttcgcgggcccggccttgcggccggccatatgggtcagataggccacgatatggtcgatatcggcatcgctcagctcgtcggcagagaaggccggcatcaccgatccgggccagctgcgcaccgatttcgtgttgcggatcagctgcttcagtgccgccggctggaagtactccgtggggttcatcggcaggttcagatccggccccagctcggccggcccggcaccgttgatcttgtggcaggcggcgcactgcaccgcgaagacctgctcgcccttccgctccggcgcatcggccggcagcgtctccgccacccgcatcggcgggaaacggtccagcagcggcacggtggcggtgaagctcgccacctgatagggccattgctcctgagtcaccccgctcgccgcggcattggtccacaccacgtagaacgggcccggatcggcatccttgtcgggcagggtcggccaaccaccatcagcggtggcgccatcagccgtagatagcgccagccaggcccgggcgcggtcggggcgggtttccagcaccagggccgccggcagctgggcgacgaacccatccagcgccgccacctccagatggtcgtcggccgccaggccgtgatcggccaggatcggcgccagcggtaccgccttgtagcgcatgggccggtgatacgagacatcgtccggcacatcgatcacggtcaggtcgggccgcttcagcagggcctcgcgatccagcgaaaacacccggccctcgatcgcgaagctcaccgccggcacctcggcggcgttcagcccggctgccatcggcggcaggctcaccagagccagcgccacggcgatcgccgcgacacccgcccgcacgcgtctcgtcacatgtgccatcacatcacccatcacatcccctttccggccgtcgtcatcccgtgcgaccggttgggatgcagtatgcaccagtccggctttgtcggcgcgtggattgaagatcctgcgtaaacgtcggtggatgccggtccggtgccggatcatggacccttgcggacgaagcgctgtacctggccgccgatccccggcaagcttggcggaccatctttctccgcgctgcggaccctgcgccagatcggttccaaccatgaccaccacccccaacccgcccgccggcccggagccggtcggaacgcagtcgctcgcggcctccaacccgtcgctcgcccccaacccgtcgctcgaccgcctgaagggcatcggcctgatgatcgtggcggtgggccagttcgtggccatggacaccatcgccaagctgctctcggaaacccagccggtgccgcagctggtctgggcgcgctatggcttccatctgctgtggatgctgccgctgatcccggttttcgggctccggcggatgatctccacccgtgtgcccggccgtcagctcgcccgctcggccctgctgatctcgtcgaccgtcttcgcctatttggccgtgcaccgcctgccgctcacccagctctatgcagtaaatttcacggcgccgctgatggtgaccctgatgtcgggtccgctcctcggcgaagcgatcggcccgaagcgctgggcggcggtgctgctcggcctcggcggcgcgctcatcgccgtgcgccccgatccgggcaatctcgatcccggcattctctatgccttcgccatggcgctcagcttcgcggtctatcagatcatcacccgccagatctcgccctatgacgggccgctggtcgggctgttctatgccgccctgttcggcttcacgctcacctcgatcgcggtgccgttctactgggcgccggtcgatgcccgaacctgggtgatgatggcgctgctcggcctgttcggcgcgctcgggcatcttgcgctgatctcggcgctccgcctcgctcctgcctcgctgatctcgcccttcagctatacccagctgatctgggcgaccgcggtcggcttcgtgatcttcggccatctgcccgatcagtggacgctgaccggggccgccatcgtggtcgcggccgggctctatctcgctttcggggaacggctgcgcttccgtcggcgttgaagaggcagccccgcccgggggagatgcccatcttcgaggagccgccagccgtgagcgtgccagccagtccccgcaccgataccgcccgcctcgccgggatcgtcgaccgcaaccacgagaccgcggtcgacttcctctccgaactggtgcgcacgccctccgacgcgccgcccggcgactgcaccgccatcgccgaggtcaccgccggctggctggagacgctgggcttcgaggtggaacgtctgcacgtgcccgaggcagccttcggggcagccggtgtcgccgccgcccccaacctgatcgtgcgcgaggaattcggccccggcccgaccgtcgcactcgccgcccatggcgacgtaccgccaccgggccatggctggtcgatcgaaccctatgccgccgtggtccgcgacgggcggatgtatggccgcggcgccgcggtcgccaaatccgacatcgtcgcctatgcgctggcgctccgggcgatcagacaggccggcctcagcctcggcggcacgatcgagctgcatgtcacctgggacgaggaaagcggcggcgaggtcgggccgccgctgatcctggagcggcggaaaacccggcccgatttcgcgatctgctcgggcggctcctacgccgtcggcacccggcagaacggctgtctgcatctggaggtgacggtagagggccgctccgcccatgccgcccggcccgagagcggcgcagatgcgatcgaggcggcgctgcggatcatgcaggcggtctacgagctgcgcgaccggctcgccgccgacggccgtccgccactggtgatcggcagccttgccgccggcaccaaccccaacatggtcgccgaccgcgcccgcttcgtgatcgatcgccgtatcacccccgatgaagatcccgaagcggtggagaccgagctgatccgcctggtcgaacggaccggcgccggggccggtgcgctcaagacccactgcacgcgcctgctgctcgcccgccccctcacccccgtgggcgaggtcgcccgcctgtcgcaggcgatccgccacgccgccgctcaggagctgggggaagagatcggcgaggccacctccccgctctattccgatgcccgccactacgccgcggccggcatccccaccatcacctatggcgccggcccccgcgatcccgaggacgcccacggccaccgcgccgatgaacgcatcaccctcgacgatctccgccgcgccacccgcatcatcgccgccgccctggtggagctgctgccggcgggggcgagaaatgcgggaaggaagagctgatccgccttgaaaccgaccaatctggcatcacccgatcgggtattgggtgacgtcccataggcctcaaagagaggcatgccgaagaagtgccgttgtgcatcggcaatctggcagatcagtggccatatccggcgatcttcgacagcaaccccggccagaacttcataaggggagtaccgccgatcctgctccgattcatcgacaaataatgcccagctcacctgcggagcccccgtcatcagcctcctgggagcatgctccgatgccatgcccccatcatcgatctgacatgcaatattacataaccccaggtagatttttcagaaaaatatatcgatcagatttgcgggctaatcgaccttctcccgcggcaacagcgtcgccgccaccgccgccgcggcgagggccggcaggatccaggcgtcgggccagtccatggcgatctgggtgagggtcgagagcaggcaccagagcagcggcaccggcaggagcagcaggcgcaggcggagcggtttcagggcaagcaggcccagggtgaagagcgcggtggcatccggggtcacccccaccagttcggccgagagccagggtcggcccgaaagcggagcggcgagcggcagcaggatcacggccgcggccatgaccagcaggccggcatcgcgggcggcgggcgggacgcggacatccgggggctgttccggctcggcgaaggccgtcgccagcagcagcacgccctgcagcatgaagccggcagccggccagaccgccgcccagttgatctcgccatagcgctgataaaggaaatcggtgccgatccacacccagaccaccgccaggatcggcaaggcgatgcgcatcatccgcggctccaccccgccgcggcgcaggatcagccaggggatcaccagcatggcgatcaccaccgggatctgcagcggccagatcgcctcgtgatagcggatgaacaggcgctgataggtctcaggcgcaaacagcaggaagtcgttcagggtatagtcggtccagggcatcagactgccgcctcgacatccgcggcgatccgctcccgcaaggcgcggtccggcagcgggcccgatgccgccgccagattttcgcggacatggtcgacgcgggtcgtggccggaatgacgcaggttaccgccggatgtgccaggatgaatttgagcagcgcctgcgcccagctcgacacctccagctcccgcgaccagccgggcagcggcacccccgccagccgccgggtcagcgcgccctgacggaagggccggttcacgatcaccgcctggccgtgatcggccgcgagcggcaggattcgcgcctcgacctcgcgatcgagcgggttgtaggtgacctgcacgctgtccagcggctgcgtcgccatcacctgctcgaagctgtcgtggcgccggccttccgaggtggtgatgccgacatggcccaggcggccttcggccttcatcgcgaacagcgtctccagatgatcctgccaggcgaggaggttgtggacctgcatcaggttgaaccgtttcacgccccagaactcgcgcgtttcctcgatctgctccggtccgtcttcgcccgacgaggtccagaccttctcggcagagaacacgcggtcgcgggcatccagcgccgcgagcccctggccgaccaccatctgcgacgacccgtacatgggcgagctgtcgatcacccggccgccggcctcgaaaaaggcacgcatcacctcggtgcagccggcgatggcttgcgcgtcgcggccgacattgaaggtgatccacgtgccgagccccaccgcgggcagcagaacgccactcgagggaatcggccggtggagcggaccgtcggctgccgtcgccgccccggcagcagcggccgcaaccggccgcagagcaaacgctgccgccccggcggccaggccgcccaggacgtcgcgacgcgtgggccggaggatgagtcggccggtgaaaggcatctccgtcatcggggtgggtctccggtgaccgggctggaatgaggcgcaggcccgttcatacggatctgtgtcgcaaatccgatatggcaaccccattgtgccgtcctgtcggggccggtcgtcagctccggtcctcccgatccggcaggcgggggacgggcagctgccagccatgccggatcgccatgacccgcaatccgaaacagagcgccgccccggccagcatcgagggggcggccggcaggtcgagggcatgggcggtgaccaccaccccggcaccggcgagcgccgcgaccgcgtagagatccgccttcagcaccgccggcacctgggcgaccagaacgtcgcgcagaatgccgccgccgatacccgtcagcatgccgagcagcgccgccatcgccggctccagcccggcccccagcgccttctgcgcgcccgagaccgcgaacagcgcaagccctgccgcatcgctcacctgcaccgggttgcggaagcgttcgatcagcgcatgacgatagaaggcgaacagccccgccaggcaggcggtgagcacatagcgcggctggctgatcgccgccggcggcaccgcgccgatcagcagatcgcgcaggatcgccccccgcgctcgcggccgcaaaagcagcaccagcacgccgaagagatccagcccccggcgcaccgcgaccaccgcccccgacagggcgaagacgaaggtgccgatcagatcgagtgccgccagcaccgtgccggcggtcaggatgccatccacgacccgccccggctcaggcccggccggtcgcgcgcagcatcagccgccagggccagctgagcgcattgatcacgccgtcttctccccctttggcggccaggctgcggcgggtctgctccgccatccagaagatgaccggcgcccccgatacgacaagcaggaagctgatcaggtcaggctgcatgacggtcctccccgctttccgagacagcgatcctcatgtccacgatatatgccgtgagcacgaccaaaacaatcatgaccatgcccagccgccagaccgcgaagctcacctgtccaccggagacggccagaacgctgaaaaagatccacagcagtgtcgtgaacagcaccagcaccgcaaaggacagcatcaccccgtgcgtcggccatctcttctggcgcatgaagttcagaaacgaggcgagcgccactgatatgccaacgagcgaaaaatgccccagccagttctgatcaaggaacggcaaggccccgattgccaccacaaggtttaattccaccagggcagcaatcaacgcgtgtcccaggacagggatcaggccgaagatgatcccaacgaaaaagatcgtccgctgttctttcttcgcccgccgcaggttggacatcgtggctctcgggagatgtctgtttcccggatactggatgccccgccgcagaaactcaacagattataatgcgccccgtactcaatccctgatccccaccgcctgaaacccgccatcggcggcgatgatctggccggtgacatagcctgcggcatcgccggccaggaagcggatcacgctggccatctcttcgggcgtgccatagcggccgagcgccacgcgctcttcccacgaggcgcggacctcggggcggtggacggcgcgggtcagcggcgtgtcgatcgggcccggcgcgacgcagttgacccggatgccgtgggggcccagttccagcgccatcacctgggtcagcagatggacggcacccttcgatgcgccataggcggcccggccgcgattgccacgcagccccgagaccgagccgatattgacgatcgacccgggccggccggccgcgatcaggccgcgggcgacgatctggcccagcatcatcgtaccacgcagattgatgccgatgatccggtcgagcagcgccggatcggtgtcgaggaacggcacgtcgacgccgatcccggcactgttgaccagcacccggaccaggccgtgatcgcgggcgatcgcggccatggctgccgccaccgcctcgggctcggcgacgtcgaaagcggcgggggctgcacgcagcccctgccctgtcagatccgccgccacccgggcggcaccctcggcatcgcggtcggccgccacgaccatggcgcccgcctcggccagggaccgggcagccgcgaggccgatcccgcttgccgccccggtcacgacagcgacgcggccatcctgcaagccatgctcatcgcgttctccggtcatgatcgtctccttgtccgggatcgccgtcaggccgcgcggcaggacagcccgccatcgaccggcaggcagtggccggtgatgtagccggcatcgtcggaggccaggaagaccgccgccttggcgatgtcccagccatcgcccatccgcccggtcgggcaggcggcgtggcgcttcgcgatcatgtcctcggcatcggcatactggccgacgatctgggtgcggatcagcggcgtatccatcatgccgggcatgatggcattacagcggatgccctgcttcgcatattcgagcgcgatggcgacggtcatctgattgaccgccgccttggccgcgtaataggcgagatagggatagttggtccagcggatcgccgccagcgacgacacgttgacgatggcgccgccgccgcccttcagcatttccgggatggcatgcttgcaggccaggaagacggaagtggcgttcacgtcgatcgcccgccgccagcgcgcctcgtccagctccaccggcccgcccatctcggtgatgccgacattgttgtgcagcacgtcgagccggccgaaggtctcgaccgtcttcgccaccgccgccgcgatctcggccgaagaggtgacgtcggccgtaaccgcgatcgcctcgaagccttcatcgcggatgatgccggcggtctcttccgccgcttcggcgacgcgatcgacgcagaccacccgcgcgccctcgcgggcgaaaagcacggcggtggccttgccgttaccccagcccgggccgctcgatccggcaccgaagacgagggcggtcttgttctccagacgcttggtcatcggaaagctccagtttttcgggcacgcctcagccggcggcgaggcccggcagcagcagcgaggcctgcggcaccagggtgacgagcagcagcacggccagcgccgccgccaggaagggcaggatcgcgaccgagccgcgttccagcggcgaccgtgcgatcatgcaggcgatgttcagacagagcccgacgggcggcgtgatcaggccgatgcacaggttcagcaccaccaccacgccgaaatgcaccgggtcgacacccagcgcgagcgcgatcgggtagagcaccggcaccagcatcaccagggcggcattggcctccagaaacatgccgatgatcagcagcagtacgttcacgaccagcaggaagaccagcgcatccgacacattggcgagcacgaaggccgacaccgcctgggggacgccggtataggccagcagccacgagaacagcttggcggcacccaccacgatcatgatcaccgcggtcgagcggccggccgaaaccagggcggcatagatccgcttcaggttcagttcccgatgcaccacgccgcccacgaacagcgcatagaccaccgccacgccggaacattcggtgatgttgaacacgcccatccggatgccgaccaggatgaagaccggcatcagcagagcgaaggcggcacgggcgagcgcccggcggacggtgccgcggggccgtggtcccgtccgcacggccggcgcatcgcggatcgccagccgccgcgcgatccagagcatggcgagggtgtagagcaggcccgggatcaccccggccagaaacaggttggtgatcgactggttggtcagcacccccatcacgatgaacgggatcgagggcgggatgaccggcgccaccacattggcggccgcgatcagcgaagcggcgaacgccggtttgtggccgaccttgatcatcgccgggatcatgatccggccgagcgccgaggtatcggccacggccgatcccgaaatgccggcaaagagggtggaggcgaccacgccgctcatggcgagcccgcccggcttgtggccgagcagcgcatcggccagttccagcagccgccgggtcatgccgcccgcggtcatcagcgagcccgcgagcaggaagaagggaatggcgagcagggtgaagccgtcgatgccgccgaagatcgattgcggcaccaccatcagattgatgtcgccgacccagagcagcacgccgaccacgcccgcgatcaccgcgaagccgatcggcaccgcgatcgccatcaggcccaggatcaggatcagcaggatttcgaccagggtcatcgacgcacgcccccgtcacgcgccgcctcggccgcgcgcatggcgaccggcacgaagccctcaccttcgtcttccaccggggcatccggatcgggcagcgcccagtcggcacccggccgcgacagccgcgcaatcaccaccatgatcgcgatcagcacgccgccgaccggcatcgccatataaggcaccgacatcggcacctcgaaagccgggctgtcctggaaggaattgaggtcggcgaaagccagaccatggatcaccagcacggccgccacccccagcatcaccagatcgcgcaggatccggatcgcggcggcggggcccgaccccagacgctcgatcagggcggtgaccgcgacatggccgccgccgcgcagcaccgcggccgagccgaccatcgcgacccagggcatcagaaagcgtgccagttcctcgctccagtagggagcggcatccagtacatagcgggcaaagacctgccagacgatcgccccggtcatggcggcgatcatgagggcgagcaccccgtcgagcacacgctcgacgaggcgtcccagacgtccggccccgacggcgacgccgcccgggccggagtcgcgctgcggggtcatgcgctcacttgaccgcgcggatcttctcgacccagggcttcagatcggggaaggcatccggcatgtcggccagcttcgccgcaaaggcgtcgcggtcgacggcaacgaaggtcatgcccttaccctgaagccgcttcttgatctcggcctccatggccgccatgcgggtgctggcatcgtccatggccttgcggccctcttcgatcagcacggtgcgcacgtcttccggcaggcgcttcatccgcgcgtcgtagaagataaaggtcatggcgccgatgacatgggcggtctccatgacatggctctgcacctcgtcatagcgcatgctctcgatgatctcgagcgggttctcctgcccgtcgaccaccttctgctgcatcgaggtgaagagttccgcgacacccatcggcaccgggctcgcacccagcttggcccaggtcatcgaatacatcttgagcggcggcacgcgcagcttcagacccttcagatcctccagcgtcggtacggcgcggttggcggtcagatggcgggcaccgcgatagccggcgccgacgatgcggaagcgggtctgggcggcgatcgcatcggccagctcggcaccgatcgggccgtcatagaccttccggaaatgatcgagatcacggatcagatagggaaaggcctcgacgccagccacgatgccatagcggtcgagcgtgccgatcgactgcagcacgatgtcgttggtgccgatcgccaggccttcgatggactgcggccagtcgccggtcgatccggaatcggcgatctggatcttcaccttgccctgggtgcgatcttcgaccgccttcttgtaggcttcggcggtctcgtaccagatgttgccgggggtgtagacatgcgccatcttgaggacgatgtcctcggcgcgtgcaacaccggtggttgcaagtgcgataccgagcacggtcgcacaggtcgcgagaccgcgaccgatcatggttctgagcatccgggctttcctccctgcaccggtcgccatggcacgcgacccgttcttgtccggtcgtcgatcaccatggccgtggagggtcagcctaacagccccggcctgcatacgcagaggcccgggtccgccaaatggacccaggcccccatgaaatcttgaagatcagccgtttccgtcgtctccggaccatatgacggaccactggccccgccagcggaaccggcggtggatcagccctgccgccgtctctccgccggcggttcgtcggcgggctgatcatcgtcatccatcaggatccgatgggcggcgccttcgatatcgtcgtactggccgctcttcagcgaccacaggaaggcggcgagcgcaccacctgcaagcagcaggctggctggaatcaggtagatcagaacgtccatgggacgatggccttccggagggggacgtcaggaccgcacgccgcggccgagccggaccgcgttcaggatcacgatcagcgacgagccgctcatggcgagggcggcgatcagcggcgtgacgaaaccggccaccgccgccggcaccgcaatcatattgtacacgatggctgccgcgacattctgacgcgcggtgcgttcggcggcgcgcgccatggcaagtgtggtgaccacggcatccagccgctcgccccggaacacagcatcagcggcgccctgggccagatcggcaccgccggccggggcgatggaggcggcagcctcggccagcgccggggcatcgttcagcccgtcgccgaccatcagaaccctgcgcccctcacccgccagatcacggatgcgccgggccttgtcggccggcagggcctcggcggtccagcgctcgatgccaaccgcgcgcgcgatcgcggccaccgcctcgggccggtcgcccgacaccagttccacccccatgccgcgcgccttcagcgccgccacggtctccgccgcggccggcctcagcggatcggcgaagcggatcagcagcggcgcggcccccggctcgacataccagagttccgggccgggaatgtcgtcgccggcaagcagtgtcgcggcccggatcgctgccgccgtctcgtcgctcagcccgcagaacgcggccttgcccaggcgcaccgcgcccagcgccatgccgtggccggcctgttccaccgccgtttccccgccctcccccgccggtgccacgggcagaagatcggccggcaccgcctgcgccagcgcctgggagagcggatggcggctcatcgccgccagcgccgccgcccggccgaggcgcgcgcgggcatctgcatcgccgagcagtgcctccagccccaccggccgcggccggccgagggtcagcgtcccggtcttgtcgagcacgacatgatccacctggcccagccgttccagcgccagcgggctttgcagcagcacgccgcggcgggccagggcggacgcggcggcgacctgggtggccggcaccgccagcgccagcgcgcaggggcaggtgatgatcagcaccgccaccgcatgcgacaacgcatcgtaccaattgatcccgaccagcgcccaccagccgaagaaggtgagcaaagccgccagatgcacggtcggcgcataggcgcgcgacacccggtcggcaaaggcgacccggccggcgcggcgctgctcggctgcctcgatcagccgggccatttcggccagctggccgtcctcgcccgcggcatcgacccggatgtcgagcggtgcgcccagcaccacggcgccgccggtcacccggtcgccgggcaccaccatccgcggcaggctttcgccggtcacaaggctctggtcgatctcgccctcgccgcgcagcaccacgccgtcgacgccgatccgctcccctgccgccacccgggcgatcatgcccggccgcacatcggatgccgccagccggcgcagcgcgccggtcgcctggtccaggatcgagaccggctgacgcgccagcgcgatcagctccgccacggtgcggcgggcctggccgcgggcgcgggcatccagcacccggccgatcagcaggaagaacaacagcatggtggcgctgtcgaaataggcatgcatctcgccgcgccaggtatgggccagagaggccgcggcggtcaggatcacgccaatggaaatcggcacatccatgttggtgcgcccgcgcgacaccgccgcccaggccgatttgaagaaaggccgaccggcataggcgatggccggcagtgcgatcagtgcggacgcccagtgcagcaggctgcgggtcgcctcgcccatgcccgcatcgccggccgcccagatgccgatcgacagcagcatcacattgccggcggcgaaccccgccaccgccatggcgcggatcaggtcgcggctctgggcatcgtcggccgccgccatgcgctcggcgtcgtagggcagcaggcgataacccaggcgcacggccggattgaccagccggtcggccagctccggcgccccctcccaggcgactcgcagccgccgggtggtcatgttcatgcgcgcatcggccacccggtcgtcggcggcgatcgcgcgctcgatcagctggacgcaggccgcacattgcagcccgtcgaccatcaggtcgatggtgttgcggccgcgatcatcggtgcggacatgggcggtgagttcgggcagctcttcatccggcctgggcggccgggcggtcgggtccagggtgcggcgggcataaagcccgtcgaggcccagttcgcggaccagatcggcagcggcagcgcagccggtgcagcaataccgtttcccggcaacacccgcggttccccgcccgatcaccggctgtccgcaatgggcgcaggcgaccgcggccgcatcctcgcggccggtaccggtcaagggtatgctcatggttcaggtcactccgtctcgcccgccttcgccgcggcaggctgccccgacttcgccccggcatcgcccgcaacgggcgcgatccagagcctgtgggtcgaaatgtggcgatccttggccttcgtgacaatgacgtgcagatcccactgcccggggcgcacgccggggcccaccagccgccaggcgcctgccggcccgcccggccgcggcatggccatcagcgccacccgctcgccgtccagcggcctttgcagccgggcctcgacattcgccccggtcagcgggccgtcggggccggccagtgtgagggcaaaatcgctctcgcccgcaggtgcccccggctcgaccgcggtggtcaccgtccagcccagccggtcctgtgcctccacggcggcgaccagccggtcgtaatccaggccgcgttcgaagggcttttccaccaccacgccggtgaagccgtccagcgccttgacgatcagcgtggtgttcaccgccaccaccaccaggaagccgccgacgaaaacccaggggatccaggcactcttgcggcctgaagctttggtgcggggctgcatcggaagactgcgggccatggctcgtctcctggctctgaaagaagatccaggtgcccggaggcacctggaggggtatcggagggggcgccatgatcagggcatctggacgggcgccacgctgttcacgcgctgggtgcggtcgccgcccgagggcggggccacgaagacggtggccacactcgcctcctcacccgtggtgaggttgcggatatgcacgtcgatcggggtctgctcttccgggatcgccttgcgcggcatggcgatgaacatccggagcgcgccctgggtgtcgccgcgcacctcgacattgtcggccggcagctcgcggccgtcgggggtgtggacgctggcgaccaggccgtcggggccgtcgacggtcaccgcgaattcagacccttcggggcggcggttggtgatcttgagcgtatagccgttgcggatggagccgtcggacagggtgacgaacagcggtgcccggtcgcggatgacggtggcatcgacccgggtgcgggtcagcatcgcggtcagcatcacggcacccagcaccacgatcaggccggcatagatcagggtgcgcgggcggatgatcttcatgtgccggggctgctcacccttggccagcgccgcctgattggcgaaggtgtcccaggtgatcagggcgttgggccggtgcagcttgtccatcacattgttgcaggcgtcgacgcagaggccgcaattgatgcattccagctggatgccgtcgcggatgtcgatgccggtcgggcagacctggacgcactgggtgcagtcgacgcagtcgccacgcagatcgaagctctcgcccttgcggtacttgccgcgcggctcgccccgccaggcctgataggtgacggtgaccgtctggtcgtcgagcatcgccgcctggaaccgcggccaggggcacatataggtgcagacctgttcgcgcgcccagcccgccagcgtataggtggtgatggtgaacagcgcgaacatggaatagaccgtagccgaggcctggccggtcagcatctccatggtcacggtcggcgcgtcgcggtaatacatgatccaggcgccaccggtggcggcggcgatcagcacccaggcgccatgcttggcgaccttgcgccagaccttgtcgaagctgagagccgccttgtcgcggcggatccgctcggcgcggtcgccttcgatcttgcgctccacccacatgaacaggtcggtccagaccgtctgcgggcaggcataaccgcaccagaggcggccgtagaggctggtcaccaggaagagcagcacggcgccgaagatcagcaggccggccaggtagtagatctcgtcgggccagatctccagattgaagaaatagccgcgccggccttcgaggtcgaggagcagggcctggtccggacgtcccggcccgcgatcccagcggatccagggcaggatgtaatagatgccgagcatcaccaccagcagggcccatttgatccggcggaccggaccctgaaccgccttggcatagaccttcaggcggttggcgaacagtgcgggcggggcggtggtgtcgtcgtgaccgcccatgtcgatgccggtggacatggtcctggctcctcggggaagaggtcggcccggccggcccttctgatgggaccggccgggcgggggggcggttattcgccgccgcccaggctgtggacgtagactgcgagcatgttgatggtggcgtcgtccaggcggccgccccagttgggcatgacgccgtggcggggctgcgcgacctgggccgtgatctgctcaaggctgccgccatagagccagacctggtccgcaaggttcggcgcgccgaagtcgcggccaccatgcccggtctcgccgtggcaggaggcgcagttgtctgcgaagatctgggcaccttcggtcttcaccgccggggccggatccgctgcgcctgacagcgacaatacataggtcgcgacggtctggatttgattcctgtcaagaatctctccaaaagccggcatctgcgacgtccgggtatccgcatcggtggccgagcggataccgtggagcagggtctggcggatggcatggatgtcgccaccccacagccagtcgtcgtcacccagcgccggatagcccgcctgaccggcaccgccggcggcatggcaggcggcacagttctcggcgaaggcgacccggccgcccgccaccgcataggtggcggtctcggggtccttcaggatgtcggcgacatcggtcgtgcggatcttggccagaatgtcggcccggcccgcctcgacagccgccaggttttcggcatgctcaacgcgggtggaatacccgagcacgcccttgaagtaggtggtcccaagcgggatgccgggatagagcaccacccagaccgccgagaaggcgatgcaggcgtagaacacgtagagccaccattttggcagcggcgtgttcagctccttgatcccgtcccattcgtggccggtggtcatacggcccgtggccgtatccttttcgatcttggtcggcatggcgccagtccttcaggcgtcgtcgtcgcgaagcgggatgcgggaggcgctgtccatcgcggccttctggccgggaaggaaggccctcacaccgatcacgacgagcaggatcatgacggcgacgatccaccacgagcggacgaactgatagacagcgaccagttcctcatagccaggcatggatgtggcctcctcactgctgcagttcgtcttccgtcaggtcgttgaaccgcaccatggtgccaaggacctgcagataggcgacgagggcgtccatctcggtcagcttcgcggtatcaccgtcgaagttgtcgacacgtgcgccgggatagcgggcgagcaggccttcggcatcgctcatcgggtccgcctgggccgcgagatccgccttgaggctgtcgatcatctccgccgtatagggcacgcccaccgtggcattggcctccagccggcccttcagactgttggtctcaagcggccggtcggcgaggaaggcgtaggtcggcatcaccgagcccggcaccagggcacgcgggtcgatcagatgcgccacatgccactcgttggagtacttgccgccgacgcgcgccagatcgggaccggtgcgcttcgacccccactggaagggatggtcgtatttgctttcggccgccaggctgtaatggccatagcgttccgcctcgtcccggaagggccgcacctgctgactgtggcaggtgtagcagccttcacggacgtagatgtcgcgcccggccagctccagcggggtgtaggggcgcaccccgtccaccgcttcgaccgtggtctcgatggtgaagagggggatgatctcgaccatgccgccgatggcgacggtgccgagggtgaggatgaccagaagcccggtgcgcttctcgatcttgtcatgcgtgagcgccatcggatcaggcctccaccgctgcggcggccgcgggcttgcgggcagccaccggctcgccggcacgcaccgtcatgatcaggttgtagaccatgatcagggcgcccacgaggaacagcacgccgcccagaccgcggatgatgtagaagggatgcatggccatgacggtctcgatgaagctgtactgcaggaagcccagctcgtcataggcgcgccacatcaggccctgcatgatgcccgacacccacatcgaggtgatgtagagcaggatgccgagggtcgaaatccagtagtgccaggcgaccagcggcagcgaatacagctccttcttcttccacagcgtcggcaccagcatgtagatcgcgccgaaggagacgaaggcgacccagcccagcgcaccggaatgcacatggccgatggtccagtcggtgtagtggctgagcgcgttgaccgcgcggatcgacatgaccgggccttcgaaggtcgacatgccgtagaaggcgaccgaggtgaccaggaagcggatgaccgggtcggtgcgcagcttgtcccaggcgcccgagagcgtcatcaggccgttgatcatgccgccccaggagggcatccacagcatgatggagaagaccatgcccagcgtctgcgcccagtccggcagcgccgtatagtgcagatggtgggggcccgcccagatgtagaggaagatcagcgaccagaagtggacgatcgacaggcggtaggaatagaccggccgttcggcgcgcttcgggatgaagtagtacatgatggccaggaagccagcggtcaggaagaagcccaccgcgttatggccgtaccaccactgcaccagcgcgtcctgcacgcccgagaacaccacatagctcttcgagccgaccaggcttgccgggatcgcgaggttgttcacgatgtgcagcatcgcgatggtcacgatgaaggcgatgtagaaccagttcgccacatagatgtggggctcacgccggcgcacgaccgtgccgatgaaggccacgaaatagcagacccagacgatggtcagccacaggtcgatataccattccggctcggcgtattccttgccctggctgaagcccagcaggtagctgagggcggcctggacgatgaagaagttgtagccccagaagatgaagcgggcgagtgccgggccgccgaagagcggggcgcggcaggtccgctgcaccacatggaacgaggtaccgatcagcacgttaccaccgaaggcgaagaccgccgccgaggtgtgcagcgggcgcagacgcccgaacgaggtgtattccaggccgaggttcagcgaggggaaggccagctggaaggcgatataggtgcccgccagaaaggccgcgacaccccagaacatcgcggcaatgacgaacagacgcaccgtctcttcgtcgtagcgggcggcgctgcgcacgggcgcggatgcgcgcgtcgtgccgtcgccataagttgcggtcatcgtcatttggtcaccgctccggtgtcagagggcgcgcgtcacagatcggggccgtcggcggggagatgtccctcgccatcggtctcgaccgctgcgtagtgccggttgatctcgccgacgatgtagacgatcgccagcacgcccaggcccaggccgaagatgcggatgcccacgtccatggcgtgtcccgccatgaacaggccgaccacaccggccaccgtcagcagtgcgccgatcacgatcgagacgccatcggcgccgatcggcctcttctcgcccttgtcgctgttgctcatgcccgtatcctcgagtcttggcccatctgcgggtgcggcggcgtcaagggcccgcttcgccccgccggctttcaacggaacccggggcacacgtcacccctgcccgtctccatggttgcgaccctattccgcccggaagctcacagccttgacacaggtcaaggcgggtcgtgacagggctggtgaggatcggtcaggatggcgttcaggaccgcggcggatggtcgcacaaccgttacccacgccttccgatcacccggacgactggcccccatgttcgatgccatcgatctcgacacgcttgcggcgctgtgccgcccggccttcagcggcgatgccgcgggctggggcgggcttgcggcgctcatgggtgcgctcgccctcgccggccttgccggcgggctgatgcactgtgcgccgatgtgcgggattttcgtgctggcccaggtcgatgcccggctcgcccgggtgccggtcgcagccatgtcggaagcgaaccggctccgcgcggggctgctgcccggctatcatctgggacggatcgcgacctatgccgggctgggcgccgtggcgggcctggtcggtcagggtctgggggacgggctggcgatggtaggccggctgcgcgactgggcggcggtgccgctggggctggccgggctggtgctgctcgcctccgccgcagcgcggctcggcctgttcggccggttgcatgtcaggccacagaacgcgatcaccggcggccatggccgccctgcagccggcggtgtcgccggcttcgccgcccgcatgctcacccgggtgcggccctggctcgccggcggcggctgccgcggcgtcggcacggggctggtgctgggcttcctgccctgcggtctggtctatgcggcgctggcggcggcactcgcctcgggccggccgctggccggcgcgctcgccatgatcgccttcggtctcggcaccgttcccgccctttcggcggtgggcctgggtggccaggcagtgctgcgccgccgcccggccctcgcccgcagggccgccccggccctgctcggcctggccgccctgccgctcatcgccggggcggcggtgatgattgtgggatgaatgccctcgcgatctcccggcttacgatcctccggtgatcacctgccaggcaatcggcatatatcccggatccggcgtcgccggcttctggaagatgaagaagccgttctgattgccgctctgattgttgaaattgatggtgtaggtcacgccacccgcctgatccagggcttcgtcaggcagggcgccatcagcagacggctgatcggcgggggtttcggtcggcttttcggtggtcatgtcggctactcctggttccgatgtcgggtagcatggccggtcccgggccggcgcgccagtcccggcccgcggcgatatcgcccgcggttgaccggatcagaccccgaccagccgccgcgccgcgccgcctgtatccgccagcgccgcccccggccccgcccaggcgacgcggccgcgttccaggccgacggcacgatcggccagacgggccagtgccttcaggtccttgtcgaccaccaggatggccagcccttctgctttcagccgggccagcgccgcccagatgtcgcggcggatcagcggcgccagcccctcggtcgcctcgtccaggatcagcaggcggggattggtgagcagggcgcggccgatcgccagcatctgctgctcgccgcccgacagcagccgggcgcgctggccggtgcgctcggccaggcgcgggaacagctcgtgcacccgggcctcggtccaggggccggggcgcgcggtggcgaccaggttctcgtgcacgctgaggccggggaaaacctgccggccttcaggcaccaggcccagccccgcgcgggcgatgcggtgcggtgcggccccggtgacatcggtgccgtccacccggacccggccgccggtcaccgtcaccagccccagcgccgcgccgatggtcgaggatttgcccatgccgttgcggccgatcagcgccaccacctcgcccgcatgcacggcaagatcgatgccgaacagcacctgcgccggcccgtagccgccggtgacgccgaccatttccagaaccgcggtcatgcctcgtcctcgcccagataggcggcgatcaccttcggatcggcgcggatcgcgtcggggctgccggacgcgatcgcatggcccgccaccagcaccgtcacccgatcggccagcgcgaacaccgcctccatgtcgtgctcgaccatcagaatggtggtctcacgcgccagggcccggatggtctcgaccatcgcggcactttcgtcgggcccgagccccgccaacggctcgtccagcagcagcagccgcgggcgctgcgccacggcgagcgcgatttccaggcgccgccgctcgccatgggacagcacagccgccggccgccggtcggtggggtcgagcccgaagcgcgccagcaccaccgccgcccgcgccgtcagatcccggtcccgcgcccgggcggcgaagggccgccagacggcgcgggtcggcgccagcagcccgacctcgatggtctcgatcgccgtcaggctggggaacagggcgacgatctgataggcgcgcaccagcccgcgccgggcgcgggtcaccacgcccagggcaccgacatcgcggccgtcgaagaggatccgcccggcatcggtcatgatctcgcccgaaatcagcgcgcaggccgtggtcttgccggcaccgttggggccgatcagcgcatggatctctccgggcatcacctgaaacgacaggtcgtcggcggcggccagcgccccgaagcggcgggtgacgccggccagttccagcagggccgcggtcatgcccgcccccgccgccggatccggctccaggcccggccaagggtgcccgtgaccccgccccggttgaaaatcgccgccagcaccagcatcggccccaggatcgccgcccaatgttcggtccagcggccgagcatctcttccagaaccaccatgatcgcggcaccggccacggccccggcgggcgtcgcggctccgcccagcaccaccatcaccatcagctcgcccgatgtcgtccaggcaagcggcgtcgggctcacgaagccgatcaggttggcgttgagcgcgcccgccacccccgccaccgcggccgccgtcacgaaggccgccagcctcaggccataggggcttcggcccagcgccctgagccggcgttcgtcgtcgcgcgccgctgccaacaccagcccgtagcggctgcccgatatccggtgggcgatgccgagccagagcccgagcagggccacacagatccagtgaaacaccagatcgtcgccggtatcgaggccgagaccgccgatcgccgcggtgttgcggctccacatcgacagcccgtcctcgccgccgtaatcggcgaaggcgatggtgacgaaatagagcatctgcgagaaggcgagcgtgatcatgatgaaataggcaccgcccgtgcgcaggctcaccgcgccgatcggcagcgcgatcagcgccgccgccaccgccgcggccggcagggtgaccagcaggctgtcagagccggtgccggccaggaagcccagcgcgccctccatgccctgggcatggtgaaaggccacacccaccgcataggcgccgatgccgacgaaggcgccatggccgagcgagggcagcccggcgccgccgatcagcaattgcaggctggcggcggccagcccccagatcgcgatccgggtggtgagcgagaccaggtacgaggccccggccgcctcggcgaggaggggtgccacggccagcagcaccagcagaacgatcgccgcgcggccgccgcggccgggtacggtgatatgcatcgatgccgatgcatctgcaacacccgccccggccggatgcatcgacgtcgatgcagtttcgggctgacgctcagtcccggccaccgaacacccccttcggacggatggccagcaccaccgccatcaaaagatagatcgtcatcgatgcaagtgcggccccgatctggtcggccgcggctggcggcagcagctcgcgcgccagctgcggcagataggcccggccgagcgtgtcggcgaggccgacgatgatcgcgccgatgaaggcgcccttcaccgagccgatgccgccgatcacgattaccacgaaggcgagaatcaacaccggctcccccatgccgacctgcaccgccagcaccggcccggccatagcgccggcaaggcccgccagcagcccgcccagcgcgaaaagcacggcatagagccggccgatatcgacgcccaaggctgcgaccatgcgccggttctgggcgccggcacggatcagcatgccgaggcgggtgcgctcgatcagcaaagcgaggcccccggccaccaccaggccggccaggatgatcgccagccgccaggccggatagggcgtgccgggcagcacctccaccgtaccggcggcaaaggcgggcacgtcgaggaagagcggccgcggcccgaacaggatccgcaccatttcattggcaaacagcacgatgccgaaggtggcgagcacctggtccagatgatcgcgggcatagagccgggcgatgaccagccgttcgatgacgaagccgagcagggccgccaccggcagcgccgccaggatgccgagcgggaccgagcccgtctccgccgcaacgaaagcggccgcgaaggcgccgcacatatagagcgcgccatgggcaaggttcagcacgcccatcacgccgaaaaccagcgtcaggccggcggcgatcatgaacagcatgacgccgagctgcaggccgttcaggacctgctcaaggacaagggaagacatgagcggatgcaggatcaccgccggcagccgcgggatcgggtggagtcagctcccctcccccgcggccggccggtccggtatcacatcttgcaatcggccgcgtaggcgtcgacatggtcgtcgaacaccttcgcgacgatgcggttcaccagccggccctgatcatccttcaccacttcgcgggcgtagagatcctggatcgggtgctggttgttgccgaagcggaattcgccgcggacgctgtcgaactttgcggccttcatgccggcccgcagcccgtcgcgattggcgacgtcgccgccgaccgcttccagacccgcgcccatgatatgcgccgcttcatagccctgcatggcatagaccgagggcagacggccataggccttctcgaagcccgcaacgaaggccttgttggcggggttgtcgagatcggtcgaccactgcgcgccgttgatcacccccagcgccgcatcgcccaccgccggcaggatgtcctgcgagaacgagaaggcggggccgtagagcttgatcttgcccttgagaccggcctgatcgaactgcttcacgaagttgatccccatgccgccgggcaggaagatgaagacgccctcagggtcggccgcgcggatgctggcgatttccgcggcgtaatccagctggcccagcttggtatagacctcctggaccacttcccccttgtaatagcgcttgaagccggtcagcgaatccttgcccgccggataattgggggcgatcaggaacatgcgcttcagcccggcctgctccacggcggcaccggttgcctcgtgcaggttgtcgttctgataggcggcgttgaaatagttcgggctgcagccggcaccggccagctgcgaggggccggcattggagctgacatagatcacgtcgtcgcgggtgaccttgggcaccacggccagcgccaggttcgagaagacgatgccggtcatcaggctgacaccgtcttccttgaccagccgatcggccgcctgcacggcgatttcgggcttgcgggcgtcgtcgacggtcagcacctcgaccggcacgccgcccagcttgccgccggcttccgtcaccgccagcatgaagccgtcgcgggtgtcgacccccagccccgcgccatcaccgctcaaggtggtgagcaggccgatcttcaccggatcggccgcctgggccgccgccagcccgaagcccatcacgatacccgtcgccgccgcgatcatccgcgaggccgccttgttcgtcgtcatctcccgtcccgtccctgcgaggtgtggccaagcctttcccggcggccccgcgctccccgcggacccgcctgcccgtcccggtggcccgggatcaggtaaaggccttgaaggtgatcatcgtgaaggtgtccttgacgcctgcaatggcgtggagcttctcgttcacgaaatgcccgatgtcgcggccgggcgccagatagcacttcatcagcaggtcgtactgacccgagatcgaatgcacctcggaaatctcctcgatcgtcgccaccgcctgatgggcgacgtcataggccttgccgagttcgcatttgataaggacgaagatggtctgcatggggctccgaccggcatgagatcagggaaaatgggccggcggcaggggcgcacacggccgtttcgccgaccgtacccggttttgcccgctttgggtagcggctgcgccggaactctgcgcgccaagacagggattaaaaacgacaaaagccggccaccatgaaaggtgccggcttgatccgatcttcagctcgccctgcttcgggagagtggtgcgaccagcaggacttgaacctgcacgccctttcgggcactagcccctcaagctagcgcgtctaccaattccgccatggtcgcagcggtgtcgtgtggtccgtggttatacgcaaaaccgtcccggatgcaagcatcgtcgtcagaaaaacgacacaagatccggtatttcggctttgccaacaaaaaacccgccgaaccgaggcgggcgtttcgttgacgatgacgcttcccgatggtcaccctccttttggagagtggtgcgaccggtaggacttgaacctacacgtccgtacagacactagtacctgaaactagcgcgtctaccaattccgccacggtcgcatcgggcgtcgtcgtcgtggcggtcttatagccaatactccgggaggagcgcaagaggtctttttcatggggacgcaacatttctgagggggccggggcatgcccgaaaccaaaccattgacctgtaatgaaaatgccatatccgccccttcgaaaaaaaatctgcgcaccgcctccgccccctctcggaccgctcatgacgcctgcaaacattgacacccgagccgcctccggggcatgctccccccacttccgagggggagtagccgaccgcgaccgggcagaccagcccggcaggacggatcgcacgtcaacagacttgcccgccggccctgtgtgccggcatccggcatggcgtgcgagcgacggggaccatcccggcgccggcgagaccttcggacgcgatcgcatcgaccgtcgacaccagcgcgacgggacggccggaccggccgatgcgtgtcgtgtccgatcgtgctcgctgcttgcgcgccaggaattcaggtccggccgtccaccctcggaggcagatcacatcatggaagcgctcgcggtctccacgctcgtcgtggccctggcggaaatcggcgacaagacacagctgctcgcactcgcgctcacgctgcgctaccgcaccccctggccggtggcggctggcattctggttgcaacgctcgccaaccatgccgtggcgggcgcggtgggggccgccgtcgccgcccatgtcgatccgcaatggatgcgctggatcctgggcgcctcgttcatcgccatgggcctctgggttctggtgccggacaggctggacgaggatgaaggcccccgcaccaccgcccgcggcgccttcctggccaccaccctcaccttcttcgtggtcgagatcggcgacaagacccaggtcgcgaccgtggcgcttgccgccgattatgcgccgctgatcgcggtggtcatcggcaccaccatcggcatgatgatcgccaacctgccggtcgtgttcctgggcgaccgcatcacccgggtcatcccgctgggcctggtccgcaaggcggcagctgccctgctgatcgtgctgggcgtgctcgccctgctggacggcggcgaactgctgcacctctgagggaaacgcaggacggccgtcccgatcttgccacttgaaccggcgccgccgacggtgaacatgtcagggcaagacagatctctgccatccggtgacggcagagccggaacggagcccgggtggcatggatgacggtggggcaggcagatatgcggcgggtgcggcggcggcgctcattgccccggcggcacggcgccccgccatcgccatccgggacgcgacccttgccgatatcgacgcgctgctggcgatcgaaaacgcctccttcgtccacgaccggatcagccgccgcagcttccgccatctgctgacccgcgcccatgccgatacggtgatcgccgaagcggcgggtgccgacggacggatggtcgtcgccggttatgcgatggtgctctacaacaccggcacccggctcgcccggctctattccatcgccaccgcccccggctggcgcggggcggggatcggcggccggctgctggccgaggtggaggcccgctcgcgggcggccgaggccaccaccatccgcctggaagtccgtgccgacgcgcccgatgtggcggcaatctatgaacatgccggctatcgccgcttcggccgctatgtcgcctattacgaagatgcggtggatgcgatccgcatggagaagtcgctggcccggcgcctggatccgtcgcgcgaccgcgtgccctatgtggaacagagcctgcccttcacctgcgggccggcggcgctgatcatggcgatgcatgcgctcgaccccgaacgggccaccggccctgaggaggaactcaggatctggcgcgaatccaccacgatcttcatgacttccggccatggcggctgctcgccccatggtctggcgctggcggccgccgcccgcggcttcggtgtccgcctgcacgtcaccggccagggcgtgcccttcgtcgacggcgtgcgcagcccggagaagaagcgggtgatcgagatggtccaggccgaattcgtgcgcgagatcgcggacgagccgctgatcaccctcgacgaacggccggccacgctcgacgacatcgccacggccctcggccagggcgagatcccgctgcagctggtcagttcctggcgcttcgaccggcagaaggcaccgcattgggtggtggtggtcgcggtggacgacgcctgcgttcacatccatgatcccttcgtcgaccgcgacgaaggccgcgcccccatcgactgcatccgcatccccgtcccccgccgcgatttcgagcgcatgtcgcgctatggccgcgcggggctgcgtgccacactcctcatctcctcccttcccaccccgggttcctgagccaatgcaccggcatatcgtcatcgtcgaccgccccgaggatcgggcatcggtacctgccgccacgggccgcgtggtgctgacggcgcgcgaatacgtcgaggcgccgccgcccgaaaagcccggcgccaaggtggtgaacctggtgcgggaccaccattatctctcgctcggctattacgcctctctgctggcggaaggccggggcgagaaggtcatccccaccccccatgccctgaccgagatttcctcgaagcgcatctacgcccatgcgctgcccgagttgacggcaatcgcccggcggcatctgctggcgccggcagacggcggcgcggtcgcccgcacggtcacggtgatcttcggcgagacctgcgaggccgagaccgcagcgctgggccggcgggccttcgagctgttccgcctgccgctgatggcgctgcacctcacctacggcgcgtcggaaccggccgccggcggccgtctgggctggacggtgcgctccatgcgcagccgcagcctgcgcgggctggatgcggccgaacgcggccggttcgacacagcgctcgaccgcttcacctccgatcgctggcgcgacccgaaaccgcgccccggcagccgctacagcctggccatcctgcacgaccccaacgacccgctgccgccgtcgaaccccaaggcgctggagcggttccgcaggatcggccggaccctcggcatggaagtggagctgatcacccggcgcgactatccgcggctggccgaatacgatgcgctgttcatccgcgagaccacccggatcgaccaccacaccttccgcttcgcgaccagggcgcagcaggaaggcatgccggtgatcgacgatccgcagtcgatcgtccgctgcaccaacaagatctatctggccgagctgctgcgcacccacgacctgccggcgccgcgcaccatgatcctgcatcgcgaccggctgctggaggccgaagcgctgggctatccgatcgtgctgaagatccccgacggcgccttttcggacggtgtcttcaaggccgagaaccgcgagcagctggtggcactgggcgcccgggtcttcgcccgcagcgagctggcactggcccagtccttcgtctacaccgccttcgactggcgggtcggcatcctgaaccggcagccgatctatgcctgccagtatttcatgtcgcgcaaccactggcagatcgtgaagcatggcggcgacggccgcatcgacgaggggcgcttccgcaccttcggcgtcgacgaggccccggccgaggtgatcgatgccgccctgcgcgcagccgccccgatcggcgacgggctctatggcgtcgatctgaagcagaatgccgagggcgtgttcgtgatcgaggtgaacgacaacccgaacatcgatgccggggtcgaggatgcggtgctgaaggacgagttgtaccggatcgtgctgagggagttcattcgcaggatcgatgccgccagggcaggtgctgcgacgtaatgtcgcagatctgagaggcgccccgcatccctacactgcgccgatgacggggcacgggcggcggaccgcagaccagggcaggcatgctcaccaaccggcacggcgcgttctgcgccgcgcagcgggctggctggcgctttttgccctgctgctgacccagcccgccatgctggccggcatgaccatggccgaggccggccccgtcgccatgggtgccgcggccaggaaaggcccatgtccgggccctgcgaccggcgcgccccgcctgtcgccaccggccgacccgccgtcgccgtcgccgtccgcgcgccccgcccgccccctgatcccgcagaccccccttccggtttccaggatcaggacacaagaccagatgatgacccgtcttccgccccgcggcggccgtccccggccggccgtgcgctgcctgctgtcggccacggccgtcaccgccctcaccccgcttgcagccctaaccccgcttgcagccctggccgaggatgccgccacggcgctcccccggcttcaggtcgaggcaccggccacggcctcgcgcacggcgcccgatgccgcaacccgcgcggccgagctggaggcgcgcctgcccggcagcttcgtcgtgctgccggccgccgcgttcgagaacagccgcgccttcaccctgggcgacatgatcgcgaccgtccccggcgtctatgcccagtcgcgcttcggccagtccgagaccaagctgtcgatccgggggtccggcctcagccgcaatttccatatgcgcggggtgaagctcagcctcgatggtctgccgatcaacaccaatgacggcgccggcgacttccagcagatcgacccgctgaccctgcgccaggtggaggtgctgaaaggcgccaacgcgatgtccgatggcgtgtcgatgctgggcggcgagatccggatggaaagccggacggggttgagcgatcccggcgtcaccgcccgtgccgagaccggcagcttcggcttcgtgcgcacccatgcgggtttcggcgtggccgagggccggatggatgcccatctttcggcgacgctcagccgcgaggacggatttcgcgagcattcggcccatgacaacaagaccttcgccggcaatctcggctggcgggtgagcgatgcggtcgaaacccggctctatctgggctatgacgatctctggcaggaactgccgagtgcgctcaccctggatcaggcgctgaaccggccgcggagcacggcggcgggcaacatcaccggcgaccagcgccgcgacatcacctcgatccggctcgccaatcgctggtcgatctcgctgggcgaggcgacggagctggaactcggcggctgggtgctcgacaaatcgctctaccacccgatcttccaggtgctcgactacgactatctggatggcggcgtgcaggcgaagctttccaccgccacggaattcgccggcatgtcgcacggcctcaccttcggggtgcggctggccggcggcgagaccgatgcccgacgctatgtgaacatcggcggcagccgcggcgcactcaccgccgagggcaccgaacgcggccgcacctacgaggcctgggcggaagacgcgatcggcctgacccccgccctcaccctggtgctgggcctgcaggcgatgcatgcgacccgcggctatgacgatgccttcctgtcggatggcgatgattcgggcgaggcgcgctatgacgaactcaacccgcgcctggggctgatctggcaggcggcacccgactggcagctctatggcaacctctcgcgcagcgccgaaccgccgaccctgtcggaggtgaacccgagcacggcccccggcttcgccgatatcgacgcccagaccgcctggacgctggaaatcggcagccgcggccgcatcggccggctgggcttcgatgtggcggtgttcgaatcgcacctgcgcgacgaactccagaccttcggcacgatcaccggcggcaccaccaccatcaatgccgaccgcacgatccatcgcgggctggaagccggtttcgacctgacgctgaccgaggcgctggcgctcaaggcctcctacacctggtcggatttccgcttcgacgatgacccgacctatggcgacaacgccctgcccggcgtgccgccgcaccgggtgtatgccgaactgcgctggcagccggccccgggcgcctggatcgcgcccaatgtcgaatgggtgccggtcgactatgccgtcgacaatgccgaaagcctggacgcgcccggctataccctgctcggcatccgggccggctgggaaccggtcagcggcgtgaccctgttcctggacggccgcaacctgaccgacgaggactacatcgccaccaccagcgtcgcccccaccgcggatgccaacgccgccctgttctatccgggcaacggcgccgcgatctatggggggatttcgtaccgtttctgagccgtcagccggcgtggggcttggcggtaaggtccagccccacggccttcatgatcgcgagaaccgtctgcaggctgggattaccattcctggcgaacgacatgtgcaactgctctcgcgaaaggccggtctttgtcgccacatcggccatccctttcgcacgggcgaccacccccagagcattggcgatatatgccgcgtcgccggtctccagggcctccgccataaacagcgcaatcccgtcctcagagaccagatcctccgccggatcgtagatgctcaacacatcagccataatcatcatccagtttggccgcaagctgctttgccatcacgatatcgcggtcctgtctgcctttgtcgccagcgcagagaagcacgatcaccacgctgccccgcctggtaaaatacacgcgatagccgggcccgaaatggatgcgcagctcactcaccccaccgccgaccggcgatacatccccggcatgaccggcagccagacggttcaaacgcgacgcgataagcgcccgggcccggtcgtccctgagccgcgctcgccacttccggaaggtttcggtctgccgcagctcgaacatgaattaagtctgccacgcaccgcctgcaagatgccagagcggccttacgccccaaacaccgtcttggtgatccgtgccgcggcatagaccgtgtcgcccagccgggcctcggcgtcgaggaaggcgacgcggcggccgctgcggatgacacgggcgtggaagcgcagatcggcgccgatgggggccgggcgcatcacgctgacgaagatgtcgtgggtagaggcgttggcgccgtcgggcagatgcggcagcagggccagataggcggcaggatccagcaggccgtagagcacgccgccatggaccgtgccggcgggggtggcatggcgggcatccaggcgcaggcgcgattcggcaccgtcgcgggtgatgcgcaccagttcgaaccccatcagccgctggaagggcaggctcagtaccagttcgacatcggcgcggcgggcggcgggaaagtcggggccgagcgcgccctccgggatcagcgggcccggatgttcgacggaggcggccgcggcggcaagcgccgcggccagatcggggagaggtcgggtcacgaggacggtgttccgtggctgtctgcaataccggtcgggatcaggcggccgcttcggcgagcgcccggtcgcgcagatcgcgcttcagcagcttgccgttggcgttccgcggcagcggatcggcgccgaaggtgaaatagtcgggcaccttgtagtccgacagccgggcggcgaggaaggatttcagggtggcggccacctcgtcctcggtcttctccagcccctcgcccttcagcatcacgaagcaatgggtgcgctctcccagcaccgggcagggccgcgagacgatggcgctttccgacacccagggatggaaggagagttcgctttcgacctcggccgagaagatcttatagccgccgcgattgatcatgtccttgcggcgatcgaagaccttcacatagccggcctcgtccatcgagccgatatcgcccgagcgccagaaacccgagacgaaattctcggcattggcatccggccgtgcccaatagcccttcaccaccatcggcccgcggatccacagctcacccgcctctcccgcgattgatcatgtccttgcggcgatcgaagaccttcacatagccggcctcgtccatcgagccgatatcgcccgagcgccagaaacccgagacgaaattctcggcattggcatccggccgtgcccaatagcccttcaccaccatcggcccgcggatccacagctcacccgcctctccgggctgttggcgcgcatccagaactgacccactttcggcggtgatgcgcgggtaaaactgacccacctgaagcccacatcctgagcatcttttgctcgggggatttcagga

SEQ ID NO: 66 - DNA, 83885 bp, Tistrella mobilis
atgacacgccagcttctcgcaatccttgttgcgatgacatgcctctttgcggtgcagcccgtggatgcgcgggctgaggagactgtgctgacatgccggatcgaggggcatgatcgcgaggcttcggtagccattgccggggacagcgccgtctatcgctacggcccgcccggcgggcaggccgagctgaccctcaccacgccgctggccgatctcgactaccgccgcaatagcggggccggcgacacgatcgacgaagtcgtgaccttcaacaacggcaacaccgcctatcgtgtcgccgccggcttccgggacgggctggcgccggatccgtctgcccttgttcctttcggcaggctgaccgtcttccgcaacggcaagagccttgcccggctgacatgtcgccccgacagcgtcaggcgcacgcacgatctgttgctctcccgcatgcgggccatcgggcgggagcagacctcggatggcgaaccctttccgaactatccgatcgactatccggcccctgccgaccagtcgcccccctgcgaggcgcagtccaatgtcgacagctgctggagcaggggggtggcggccgcgcgcggcggggatctgcgtgcggcgctcggccattacgacatgtcgtgcgatgccggcttcaacgatctcggctgctacgaggccgggaagatctatcttcacagccgggcgctgcgcgattacgcccgcgccacggcgcgattgacgcgggtctgcgagggggatgatccgggacaggggccctatgcctgcaaatatctgggctggatgtctctgaccggcaccggcacggcgcgcgatctggatggcgcctgggacaggctggcgaaagcgtgctttctgcacaacggcatgatcaccatcgaccccgaaggctgccatttcctggccgagaccatccgtgccgtgcagaagacccccgtgccgggattgcccgacagcgatttcctggcctatgtcgcccttgcccaaggctgcaccgacgatgccgaaaccgtctgcgacgaggcccggacgttctacgccaccgcagccgcgcgcggcgcgacatggattaccagctgcgacgaaatcgtgcgcgcccgcaatctctttgactcctgcaggcagatgacggcggcaccggcggattacgaggagatgatggcgttgcgccgcaagcttgtggcggtcttccgcgaggaactcgacgtggagtgatcgggggagagtaatcgggaggtggcggggcggcggaggtttcagtcctcgatcgcctcaatcccgcgatgcttgaggtcttcaaggtgatctttcattgcctggagccgatcggctggatgaccgctccaggttgcaacctctccggtcacgcgcaagggggcgcgggtgcggtacgacctggtcggattgcccggaaatttctggtcggtgaggttgggatcgtcctcgaacggtcctgtcggctcgaccgtacagatccggccgggcccgtctccaatcgccagctccgcaccccagatggccgcgtccagcgtggcggtcatatagacaaaggccgctgtcctgcgctgcccgaagttcgacgcaaaacctggcctgatcaggtcgcccggtttcagatcgaccttcgtcccgtgatagagcaccggcaccgggccggtcttgtcgatggtcatcggctggggctcacccgggttgttcatccgcaccgccggcggatgcggcagcttcgagtgtcgcaatgtcgatcttcttcatcgtcatcatcgcctcgaaggcgcgcttcgccgtccgggcgttcgaaccggtggtgagctccagcagcagccggggcgtgatctgccaggaatgcccccagagatccttgcaccagccacaggcgctttcctgcccgccattgtcgaggatggcattccaatatcggtcggtttcctcctgatcctcggtgatgaccatgaaggacacggattcgttgggtgtgaagatcgggccgccgttgaggccgacgaatttacggccgagcacggtgaactccaccgtcagctcggtgccttccctgccacccggataatcggcggcggccaggtttatccggtcgatatggctgtcgggaaatgtcgcggcgtaaaacgccgcggccttccgggcctcgccatggtcgtaccaaagacaggtcacgagactggtcatgtcgggtctccttcattccggccctgccggggttcaggcggggacgtcgttatctcggatattccagctgcatcgcgacgacattggccgtcgcctccccgtagcggtcggtgatggtctcgagcgcccggtcgagtgcgtcggcggggcgctcgtccgggctgatcgggagccggcgctctgccggccagccgtcatgcccgctgtccggcaggatatggatgccgttcaagctttcgacggccgcggtgttccccgacagcgtgaccgcctgcgagcggtaggtgcgcgaccaggcatcggctaccagggcgagcgagacctcgtccaagcccggcagcaggtcgatcccccagctgtcgcggttccacatcgccagacggttggcgagcacggtgatcgcgaaggggcgggtcatggcgaacgccgcgcttgcatggcgggcgtcccagccgtccaccccaagatcgcgggcgacggcttccgccttcgaccggccgccgatggcctcgatcaatgtcagcatcatcggcatgactgcggtgatgccggtggtggtgacgaccttaccgtcgaagaccatgcgccggttcgcggcatagtcgatgcccgggttgcgttcaagcatctcggcccgatagtaccagtgcgtcgtggcgcgcctgccgtcgagcagacccgcggccgcgaccaccttggcgccggcgcagactgctatgatccgggcgcccttgcggaactgatcctgcaaccatgccatcaccaccgggtcgtcgtcgcggctcatcgccggcacgatgacgtaatcggctccttgtggatggtcggcgtcgaatgcggcgatggtcgcatcgggctgcacccgaagggcgggatagagccggacagcgcccgggccggtcgccagcatgacgacatcggcgatatccgcgcgccgcaggatgccggtcgtcgcgatgtagtcgttggtttctgtggcgtcgttgagcccgaccacggcgatgacgggccggtcgtcgccttcctggcgcagaacggccagcatggcggcggcttcttccggcgggaccgccggcgcttcggctgtgagcgtggcggcaggaagactgaagatccagcccgaaaaacctgccagaccgagcagggcgagggcaagaccgccccggatggcaccggatatcgacatggctgctgcctccaatgcacatgaccggttgcggcgcgcgacagatgaaccctatctgtgctccggcctggcagacatgacaaaaaggcggtaatttctgccaatgcatcatgtggtcttcatcacctatcccggcttcgaactgctcgatgtgtcggggccggcatcggtgttcaacggcgccaatcatgctcttggccggcagggacggtctgccttctacaaggtcggtctggtctcggccaaaggaggcggcatcgaaagcagcagcggcatcgtcgtcgacacgatgccgatcgccgatctgcggcccggtgacaatcagcaaaagggggacgatcagacgatcctggttgcgggggcggaacgggcgccgctgctggccgccctggccgatccggccttgcggtcggcgcttccggcctgtgtggcgacggccgggcgtttcggctcggtttgctccggcggctttctgctcgccacgctggggcttctcgatggccatcgcgttgccagccattgggacgcctgcaagccgctggccgagagctttccagcggtcaccgtcgatcccgatgcgctttacgtggtcgacgggcggctttggacatcggccggtgtcaccaccggcatcgacatggcgctggccatgatcgcctgcgatctggacaggatgattgccggggacgtcgcgaagcggctgatcctttatgcgcgccgccccggctatcagtcgcagttcagcccggtattgcaggcgcaggtcaggggcgacagcccgtttgccgaactgatcggctggattcaggccaatctcgacgcaccgctggacgtcccctctctggccgaacgcgccgggttgagcgagcgcagcttccaccggaagttcgtggcggcgacgggcgagacgccggcccgcttcgtggagacggtgcggctcgataccgcgcgcctgttgttgtcgcgtggcttgccgcttaaattggttgcggcaaaggtgggcctcactccggttgcgcgcctgtcggacgcctttgggcgacggttcggcatggcgccgaggctgttccgctatatgcatgccgggacgcccgggcacgacgttgcgtcatgaagacgtgcagcattcaaagggcatttgaaattctggtggagcgtttcggagtccggattccccccctcggccaggtcaacttccggcgtgtcgcaggggctgagaacgaagcagatcctcatgccggatcaaaagcctgagcggcgtccggacatcctgtacaacgatgaagggtttaagaggcgctcgcctcattgacgattgccatcgccagcactcatggatgagaccgaatcgacgaggacagttctccgggcaggcagatggcaagtgacgcgcgtgccgtcgccgggacggcttgcgatgtcgagcgtgccgtcgtgcaggcggatgaacgaggccacgatcgcgagacccagaccggtgccctccttccgccggaccagcgggtcgctctccacccggcggaacggcttcagggcctcggggatctcctcggggcgcattcccgggccgttatccgtgaccgtgaaggtcagcgaccggtcgggcatcagccgcaccaccagagagatgcggccaccatcgggcgtgaacttgaccgcattggtcagcagattgatcagcacctgacgcatcttgcggctgtcgcacgagaccgcgaccggccgggagggcgtcatcaggtgaagcacatggccggccttgcgggcgcgggccgagacgatcgcgattaccggacggacgatgtcgtccactgatacggtctcttcgtcgagcgtcgcttcaccggcctcgatccgggccagatccagcaggtcgttgatcagctccagcaggtgactgccggcacctgcgatatcgcccgcatattccatctgcttaggcccgagcggaccgaacacctccgccttcagcgtctcggccatgccgatgaccgcgttcagcggcgtgcgcagttcatggctcatatgggccaggaaggcggttttggcgagattggcggcctcggcctcgtcgcgtgccgcggccagatcctgccgtgcccggtccagctcctcgacgcggagcgccagtgccgtgcggtggtggctcaaccgacggagcatccggcgatgcgattcgaaagcgcccaggatcatcatcagcagcagggtggcgagggcctcgggccacatggccgtcagcacggtggtcttcagccccgacatcgcgtcgatatggatcagcgaccagggcgtgccggcgatgcgggtgtggaaaagcgcagccgcgcctgccggcttcagaacgccgcgggcctgcgcgtccatccgtgccgcaaggtcgccggtcccgccggccgcctgccagatccggtcgggcatcccggtatcgtccacggccggcagatcgccgtcgcgggccgacagggcgatcacatggccggcctcgtcaatcagcatctgggtgccgtcgggcaggtccatgtcgtccagcatccgggcgagcgcctgttcggtcaggtcgatgccgatgacgccgcgaaaccccgccggtaatgtcgcgccggcggcgatcaccggccgcacgatcgacacgatccgccccttgccccccaagtcttcataaggcgcggtccagaaggtccgaccggtcgggttggtgtcgggccgcgcgcgcaccatcagctcggccgacatcagcgcgtcgctgtagcgggcagcatctccggcaccgaagggatagagcagcagaaagcgccgcgcagacatgtagtagatccaggcgctttccggcagctggcgcagggcgccgagcacgaaaggctcgatcgtcgccaccgccgccatttcgtcgagcagggcgggcatcgtcgacggatcgtcgggcaggcgtcccgtcaggcgaccggtcatgccggggccgggcggcacctcgaaacggtcgttctcgcgcaggaagggcaggcggagcaccggtgggcggtccatggcttgcgccgccgccgtgcccagggcatcgatctcggccgccgccacccgggccgtggtcgtaatcacgtcgccaccggtccgcagacgggcctggcgcaggtcgatctgatggttcagccggtcctgatactgaaccatcagcccggcgccggccgcccccagaaccagggcataggcggtcagcgccacccagccggtcatcggccgtcgcagccgccggatcggggggactgccggccctgcggccggcgggtcgatgtcgctggacgtctcgctcgccatgccgagacgctacacgacacccgggttcccgtcatcggaaatggcggagaacagccggtgtccgcagcctttgcgccacttcgcgcaccgggtgtcgcaatgctgccgcagtcgcgggctcaggtgtcgccggcgtcctcgtcctcctcgcgcgcccagatcggcggcgggcggttcatggcgtcgagcgcgccgtccaggatgtagccggcggcggccttgtcgaccagttcggcacggcgcttgcgcgacatgtcggcatcgatcatgtagcgctgcacggcggcggtcgaccagcgctcgtcccagaacatcatcggcaggtcgatgccgtctgcggtcaggaactgggccagattctcgcggaactggcggatcgactggcagcgcgggccttcggtgccgtccatgttgaccggcaggcccagcaccaccgccaccacgccgcgttcgcgcacgatcgcggccatgcgcgcggcatcgacccggaacttggtgcggcggatcagctcgatcggcgtcgccacccggcgcagttcgtcggagaccgcgatgccgaccgtcttggtgccgacgtccagacccatgatccggcccttcgcgggcagcatccgggccagctgccagggggtgagatcgggcttgggggcgggcttggacggcgcctccggtccggcccccgaatctgcctcggaatcggcctctgaggcggggttgcggttcgtcataacgggtgttaccttgcggcctcgctgccgctgaacgggtgtgtcgagagccgccatctggccgcttttccgccaggaatgtcaagcacggggacctgtgcctgcgcgaaggtgcacggggtgcccgtcgaccggcccgggaagcggccgtcgtcagattgactgccggttctcgcgaaaccggccgccggaaccattggagtggggcagcgacgatgacgctcgatcgagccgccgtcaggaagatcgccaccctcgcccgtctggatgtgcccgaagacgaactcgacggctatgcccgcgagctgggcggcattctcgactgggtggagcagctgcgcgaggtcgacacgcaaggggtggcgccgatgaccggtgccgccgacaaggggctgccgcagcgccccgacgtcgtgaccgacggcaattgccgcgacaaggtgatggccaacaatccggccggcgaccccgtcttcttcgtcgtccccaaggtcgtggagtgatcgacatgaccaccagaccgacggatttcaccatcgccggtgccgccgaggcactggcgaagggcgatatctcttcgcgcgaactgacccgggcgcatctggatgcgatggcggcgacccggtcgctcaacgccttcgtcgtcgagacgcccgagattgcgctcgcccgtgccgacgaggccgatgcccgtcgcgtgcgcggcgaggccctgggcccgatggacggcgtgccggtcgcgatcaaggatctgttctgcaccgagggcgtggccaccaccgcatcctcgaagatcctcgacggcttcgtgccgccctatgaatcgaccgtcagcgcgaacctgaaggccgcgggtgcggtgatgctgggcaagaccagcatggacgagttcgcgatgggctcggccaacatcaccgcggcgaccgggccggtgcgcaacccctggggccccgagggcgatgccttcctggtgccgggcggctcgtccggcggttcggccgcggccgtcgccgcccgcagcgcgatcgcggccaccggctccgacaccggcggctccatccgccagccggccgcctattgcggcctggtcggcctcaagcccacctatggccgctgctcgcgctggggcatgatcgcctttgcaagctcgctcgatcaggcggggccgatcacccgcacggtcgaagatgcggcgatcatgctggggaccatggccggtcatgacccgaaggattcgacctcggccgatatcgccgtgccggatttccgcgctgcggtgaaccggggcgtgaaggggctgaagatcggtatcccgaaagagtaccgggtcgacggcatgccggccgagatcgagaagctctgggccgacggcgtcgccatgctgaaggcggccggtgccgagatcgtcgatatcagcctgccgcatacgaaatacgcgctcgccacctattacatcgtggcgccggccgaggcctcgtcgaacctcgcccgctatgacggcgtgcgctatggccaccgcaccaaggccaatgtgtcgagcctggccgagatgtacgagaagacccgcgccgagggtttcggccgcgaggtcaagcgccggatcatgatcggcacctatgtgctctcggccggctattacgatgcctactacctgaaggcccagcaggtccgcacccgcatcgcggcggatttcgcggcggccttcgatcaggtcgatgcgatcctggcaccgaccgcgccgtctgccgccttccgcttcggcgagaagatggacgatccggtgcagatgtatctgaccgacgtgttcaccgtgccggcgagcctggccggtctgccggcgatttcggtccccggcggcatcggcgagagcgggctgccgctcggccttcaggtgatcggccggtccttcgacgaagagacggtgctggccgtcggccgcgcgatcgaggaagcctcgggcttcgacggcgtgccggccatggtgcgggagatgcggggatgagcctgatccgcggcaacacgggtgactgggagatcgtgatcggtctcgaggtccatgcccaggtgtcgagcaacgccaagctgttctcgggcgctgccaccgcctatggcgccgagcccaatacccaggtctcgctgatcgatgcggccatgccgggcatgctgccggtgatcaacgaatggtgcgtggcccaggccgtgcgcaccggcatcgcgctgaatgcgcagatcaaccggcactcggtcttcgaccggaagaactatttctatccggacctgccgcagggctatcagatctcgcagttcaagcagccgatcgtcggcgagggccggatggtcatcgatctcgacgacggcgagaccatgaccgtcggcatcgaacgcctgcatctggaacaggatgccggcaagtcgatgcacgatcagcgccccggcgagaccctgatcgacctgaaccggtcgggtgtggcgctgatggagatcgtgtcgaagcccgacatgcgctcgcccgagcaggccggcgcctatatgcgcaagctgcgcacgatcctgcgttatatcggctcgtgcgacggcaacatggaagaggggtcgctgcgctgcgacgccaatgtgtccgtgcgccgtccgggcgggccgctcggcacgcgctgcgagatcaagaacctgaactcgatccgccacatcatgcgggcgatcgagttcgaggcgcatcgccagatcggcatcatcgaggatggcggctccatctcgcaggagacccggctctacgacgtcaacaagggcgagacccggaccatgcgctccaaggaagaggcgcatgactaccgctacttcccggatccggatctgctgccgctgaaattcgacgaggccttcgtcgagacccagcgcgcggcgctccccgaactgcccgatgccaagaaggcccgcttccaggatcagtacgggctgtcggcctatgatgccggcgtgctggtgggtgagcaggtctcggccgatttcttcgagaccgcggcgaagggccgcgatgccaagctggtcgccaactggatgagcaccgagctgttcggcgcgctcaaccggctgtcgaagggcatcgaagagagcccggtttcggccgaggcgctgggcggtctggtcgatctgatccaggacggcaccatctcgggccgcatcgcgaaggaagtcttcgccgagatgctcgagacgggcgagaccgccggccaggtggtcgagcgcaaggggctgaagcaggtctcggacgaaggcgcgatcgccgccgccatcgatcaggtcatcgccgccaacccggacaagctggccgagtacaagggcggcaagaccaagctggcgggcttcttcgtcggccaggtgatgaaggcgaccggcggcaaggcgaacccgcaggtggtcaacaagctgctgaacgacaagctgaacgcctgagcccaggatcgttcggcacgccggcgcatgatcagggcccggtctccccagggaggccgggccttcattctgcgcgaccgatgcgcgcggggcggcactgccgcttgccaacgccgccgtgacgggcgatggtcctgatccaggtcatcccaaccgcagggcaccgcccccgactgctccgccattcgccccgtacagccccccgtcgatcgcgccgcagagcggcggcggtgacggtgctgctctgtgcggcgctggcccaggtgctggggctgatcgtgcatctgcccatggcgatcgccatggagctggcgccagggcaggtgcaggagatctgctcgcccaccgcccccgacacccggcgggatgatcgcgggcccctgccgggcatggtctgtcacgattgcctggcggcgcagatggcgatgccgccggccgatgtcccgccggtgccgctgcgcatcggcagcttcatcctgccctccatgctgccgccggcggggctgcccgccgtgacggccgcggtctcgccggtgccggcccgcgcaccgcccctgtccgaaagctgatcccgacaggcttcccccacaggattccatgctttcgaacaaggaccaatctccatgtcgatcatctcgcgcacgctccgcaccggccttgccgccgccgcgctgatcattgccgccggcaccgcctccgcccatgaatacaagctgggcgagctgcatatcggccatccctgggcccgcgcctcggtcaatgtcggcggcaccgccggcgccttcctgaccgtcgagaacaacggcagcacctccgaccggctggtcgcggtctcgacccccgtcgccgaggtggccgagatccacgagagcttcgaggacaagggcgtgatgcgcatgcgccgggtcgagggcatcgagatcccggccggcggcgaggccaagctcgcccccggcggctatcacatcatgctgatcaagctgaagcaggcgatcatgccgggcgagaaggtccccgccaccctgaccttcgaaaaggccggcaccatcgacgtcgaactggcgatcgaaaagccgggcgccggtgccgatatgggccatgaccataagaagatggatcattcggcgcattgatccgatcgcgacggcacggaggagatcatgactgctgatgcgctgacaatccggcaggccggtgccggcgacgccgaagcgatatccgcggtcatcctccgggccctgtgggaaaccaatgcggctgactatacgcccgagatcatctcagccgtggccgccgggttttcgcctgaggcgatcacccggctcatggccgggcgccgggttctggttgccgtatatgccgccgacgtcgtcggcacggccagccttgatggcaatgtggtgcgcagcgtcttcgtatcgcctgattgtcaacggcgtggtatcgggatggccctgatgaccgccgttgaggcgcttgcgcgggcggtggcatctccccgattgctcgtgccctcgtcggtcacggcggaaggcttctacgccaggctgggcttcattgccttgcgcgacgaatggcatggcgcggaacgcacgatcgtcatggagaaaccactggcctgatcacattccccggaaaggcgcgccatgcagtatccggttctgatcgaagacggttcggagaccacggccttcggtgtcgtgtttccggatctgcccggctgtttttccgccggggatacgttggggtcagctcttctggcggcgagagaggcggcggcagcctggatcgaagcggcggtggaggcgggtaccgccatcccggcgccctccggccctggtgacgttcggaacctggcggacggcaagggctggacgcttcacctgatcgatctcgaccggcctgacgacggtgtccgataaaaggggcaggcgttggagccggcctgtcacgcgtcttcagcggagagtgatccgaaggaccactctccgcccccgacgcccggcccttgccgatgccgcttgtttattcaccgcttgcgcgatccggtcgccggccgacccggatgatggtcgtctgcgccttatgctcagaccgaggtgatcgacccatcacccggacgacaatattcgttgatgtcgtcgtcatccggcttggaaagtgattgccgcttcgcagcagtcttgttgaaatttctgtccaaaatgacttctgccgtgaaattctgcaaccattgcattaggcttgatccatcataatcgcctgaaagcggatggattgccatgaacagcccgatcgggactcccgagcgccatatggcgcgttcggccgtcgagactgcgtcgtcgcctcggcgatatcagagccgggcggccagggtcgccgagaaacgggcgctgcgccagagcggtctgaaggtctcgcaggcaattcctttcgccgagatggccacggatccgctctatcagcggatcgccgcggccacctgtccggaggctctgaaggcagatctcgcacggttcggcctggagaacgcggccgaggtcgcggcctgcacctcgctccccggcctcaacaggcttctgtcgcgccgggctggcaagggagaggtgccggccaagggagaggtgccgggcgcggcgacgcaggcgtttttcgaccgggcccgaggcgaggcgatccgcagctatcggctgatgcggcatatcctggcggtcaaggacccgatgaacctggggctgcgccataccggctccgatctgccggtggagatggagcaggtggtgcggtcggcgggcgggcaggtttatgccaggccgtcgagcctgcaatcgagccagtcacccgctgcctatctgcgctatctctatcgcatcgctatggggctgaatcaggagatcggcatcacgccgccggagcggggcgcccgccggctggagatgcggcggccggatcttgcccggctcgtgctgagcgaaaccagcctcaagcaggaaatcgccaccatcgagctggtcgacgaggtgttggcggcggggctgggcgcgatcgatatccgcatgaccttttatccgatcgcgctgcccttcgatgaaccggcatcggcgacgcgggcggcgctcggccagatcggcggcacgacgctcaacgacattgccgcgcggacgtcccgaagcgtattcccgctccgcgccgatctctgcctcgccagcgatcaggcggggcttctggggttgaccggtgctgtggacgaggcatcgggcggcggcagcgaaatcgccctgctcaccgaggataccggcattcctcctgagagccacccgaccactctgagcggcctctacggcgtgacgaacgagttggaaaccagtacggccgtcaagctgatggcgcgtctcgatctggatttcgaccggctcgttcagttgctggggctttatgtcgttcaccaggaaaatggtcggccggttgcccagaaggattatgcgacatcatttttcgacaacaaggcgccgttccagctcatcacccggggcggccatacctatgtctatctgagcagcatcgatgtggcaccgcccgaactgcgcgggttcaactatctcgcgcgcctgcatcacgcgaccgggctggagtttcatcacctcaactggctgctggcctgtccgggtgtgagcgaggcgggcaatcccggagcggcgtgggacagggccgcccgccggcatctcaccgcgaccggcctgcgggtgctggccggctggcggctctaccgggatgccttcgatctggggccggaggcttatgcggcgctcttcggcgagatctgccccttctggcgggcagacatggtggtcgccggcgccgagggcgtgacccccgggctggagcagaccgaaatttcgttcctgcgcacgctgttcggggaggacgcgcccgccctgcatcagacgatcaccgaggcagcgaccccgatcgacgacaccggccttgccgatatggtgtgccgcgggctcaggctttccgcggtcgagctggacgcgctggccgatgcgctcgacgccgatttcgccctgaaaacggtcgtcgacgcccgtggcctgggcgcgctgtatcggcttgcgacggtctttcgcatggtcggatggccgctgctgtccggtctgcggctggtgacgctggtgagcgggcaatcgaccccggacaaccagctcctgcgcggcctgacggtcaggaacgagaccgccgacgggaccgcgcgtctgtgtacggcccttgaccagatcatcgaactggcccgctggatgacggaagcggagctgtcgccggatgcgctgctggcgctgctgacgccggccaccaccggcggcccgcgggcgagcgaggccgaccgcaggtggcttgacgatctggccgcggcggtcgcgccggtgctcgggcgcgccgacagctttcgtggcttcgagacctgggacagcagggatgcgcccgcggtcaccatccccggcgaggcctggcacgagcacatgcggacggcgggcgccctctatcgggaggcgggcgtgttttatcccgacatggaccgcgcggccatgtcggcgatctgccgcgattttctgcgagacggtcacgccgtcgatcccgatctggacggtaacatcgtccggctggaccggctgctcacgcgtcttgagaaggcccgtgacgcgcaggccctgacccttgagcgtgccctcagaacgttcggcaccacgctgaccgcttcgggcgccggcgccctggtgatctgggcgcagacaacgtcgctggatgcccttgatgctctgctggccggtgccgacgacatcaacgcgcagctccggctgcgggaattgcagcgccacgccgcggcggtcgatgccctggcgctgggcgatgtcgacttgcagatcctcgcctggcggccggattggctggcgcccaaggcggctgagagcggagctgaccggcagcgcccccgggcgctctgccttgaacagctcgtggcatgtcaccgcttcgccacgcttcaggtcggtgccgcgacggatgatgcctggctcggctatctgacggtcgcgcgtgacggccggccagggcctgaggccacggccgaggatattgcgatctggcgcacggcctgcaacgacatgctcgcgatcctgctcggctgcccggccgtggatgtcctggactatctggcggtcctcgccggcccggacggcgtggccgacgacctggagaccgtcgacgccgtggcgcgacacgcccgtctggccgaggatctccgcatcggcggcgccgatctggtcgtgttcagggaggtgggcagcccgcgcgcatgcggcgactggatggcggccgcgaccgcagcgcaggccggactggcgcgcttcaagggcggcagccagatggccggctttcgccgggcccttgccgaggtcaagcgcgatgcgctggtcgcggcctatatgtgcaccacgatcgccgccgatcccgaccttgcggcggaggtcaccgaccgcgaggccctctacggccatctgttgctcgatgtgcaggtgaccagtgccgtcccgaccagccggctcgtcgaggcgaccagtgccttgcagctctatatcagtcgcgcgctcaacgggcttgagcgtggggtcggcttcgtcgaccgtccggccctggccgcagaatggcgcctgaacaggtattaccggcaatgggaggccaaccagaagctgctgctctatccgcagaactatatcgagccggagttgcgtcagatcacttcaccggaattcgacgatctgttgcgcgccatttcgggcggcgatgtcagtgaggacggtgtcgaggcggcggtgaccgcctacatgacggggcttgccgactgttgcgatctgagcctgtgcagcatctatgtcgagcgcgggggcggaagcacatcagggcatgccatctatcattttctcgccacggcccattgggaatcggggcgcttcttctatcgcaagcttacggtggattacacggcaatcgccgcattggcggggccgtcgcagtatctcaaggcactcgactggacattctggcaggaagtcaccgttccgaagacccatgatcttctctccgatgtgacactttgcttcttcctgaacaggtattacctattctggctggagattgaggaacggaaaggcgaggccagcgacagcgatgcggtttcctggcggatacacccgcgctacatgcggtgcgatgcgaatgccctgaccggcgtgacccatgcgccgggtcttttcatcgacggtgacacagccggcggcaccgagctgctgatcatcgacggcgcgttccactggcagggccagaagcccgggctcaacggcacctatcagccgctgggcctgcccaacgtgttctcctatggcgtcctggcggccgaggccgtcgatggcgagagtggcgcgattctggtcagcttcggtgtcagccttgcggatgacccgatgtcggacgccccgcagactgtccggcagaccgtgcttcacatgcgcctgaccgagaaatgggcggatgccattctcgttctggacgatgacatcgatacgatgtttcaggatgcggcacccgccggatataagagtatctatccccgcatcgctgccgaagatccggtggtcgccgatcaatatactgtgacgaacacctatgagggcgctcagtttcttggtaattattatgaatataacagacctgccggacagcctgtcgctcttggcgtggtcattaattacggtggatcgaaagatgtcatcgtaaccacgaatttttcaccagccccgctgggcagctcgacgctcggcacggtcagggtgagtgcttatctggggcaccgcagatatctgaggcgggtctacaactcgacggcgcaggacagcagctggacggcgctgcgggaaacgcgtccggccgagatccacatgaaaatgacgatgacatatgaggttccgggggcgccgccaaagacgtttgagagcgactggctgggcggacccacggcgctctacaaagatgatttccccgacatgccgttcaaggacatggcgacggcggaaaccgagcatgtccgcgacgagacgattgagggcatcgcggcgctgccttccgaatggtcgttcgagactgcgacgaacgccgtgctgaccgtgaatgtgacgatcagaataatacccgctgacctggtgttttcgctgcttgtgaagggggagccggtcaatctcgttcgttcaccctcatcggaattctcgtatctcgacgtctctgccggaaaattcaaccttcgtccggccgagggcaaatcaaacaccggctgggcgctcggtgacgcccatggcggccacaactttgtccatatcatggatcgggaagacacgccgaacgccgggacactgcttcttctgaacgcatcgccggcgctccgttccctggcggagacgatgccccggcccggcggctgtgccagcctgttcaccgccggcaatcaggcgctttcggaagacctcggatcctttgtcgaggcgttcggccagaccctgcgagaggcctatcccaaggacgcgacgtcacttgatccggcccgcacgcccgcgcccctgttcgacttcgacggcgcctatggcggctatggctgggaaatcttctaccatattccgtcggccctggccgccggctatgtgaacgacggacaatatgacaaggccatcggctggctggaaaagatcttcgatcctggcgcgggccagccctggagagtggcaccactgatcggtgcctccatgccagctgatcattcagccttcgacaccggtgatgtcatcgtcgatccggatcggatcgccaccgattatccgttttattatcagcaggcggcgatccgccattacctggaggccatgcttgccgacggtgatgcggcctatgagcagcaaagtcaggagaccctgcaacaggcaaaggctatctatgtcgcggcgaagcagctcttcaacgagaggctgcccgagatcctggatgccgtgacgaacaagccatggaccaatccgaccctgggcgaggtttcggtcaatggctatggtggtttcctgccgccgtataatcaggcgcttcgcgacctctatgacgcgatcgaggcgcgcctcgccaatctcagacagtggctcgacatcgacggcaatccgctgaacgtccccctgctgtcggcgccgatcgacccccgggcgcttcagaaggcggcgaaagccgcgctgaccctgggccagcgcgacagccaggaggaggcggagcaggaccctcgcgtcgacttcaccaccctcgccagatcggccaagctgtatatcggcaatctgcaaaccaccagcaatcgcctgctggccgcgctggagaagctcgatggcgcgacggtcggccgggccgagaaggatgtcgaagagaagaagatcctcagatccgccgccatacaggatctgacgctggcggcggcagagaaggaggttcagataaagcaggccaatctgggcggcgccaacagtgcgctcgcctttcatctgggatcggttctggtgtcattgggggcgctgaattccttcgcggccatcgatgcggggaagaagagcgtcgaattcgtctacggcaaggcaaaacttcgatacgacatgatcagggcggtggtgttttcaaattttccgaatatctatggaacggcagccggcgggcgacgggctgaacagggggcgatcgcgaatatactcgggatgctgacgagcgagatattgtacgactcgaaaaaatcggccatcgataaatacaaggagagcagtcagaaaatcatcgaccaggtgaaaaataccaccgatctgaccacgaaggtagcttccgcttccctggagcttcagaaggcgaaggatgctcgtgatgagcagagcaagaagcgagaggcgctggatgccgaccttgccgacctcgaggatatccggacggtgaaggcgaatagtttcgccaatctcgatttctacaaatggctggtcgacgaccttaaatcactcttcgaggaggaatgggcgacgacacaggatttctgcaagctgctggtgaggctctacgaatatgagaccggagagaccaacggccccagcttcatcaagacgacgagtttcggcggcgactatcagcgcctgaatgccccctattggctggcccttgatgtcgagcggcttgaggccgcctatttccgctcgatcctggatcagcagagccagagtgccacgatgcgcatcgcgatcagcgagcttccggcgcctggcggcgatggatcggcgttgaccacgctgatcgaacagggcgagacctatttcgagctcaccgacgagatgttcgacgcgctctatccaggccagtatgaccgccgtatccagagcctgcgcgtgcgctttccggggcttgagagcgccggcctcagcccgcatgcccggctgacccagatcgccaacacacgctatgccacccgggagcgcgacccgaggcgcgggggccggatccgcaaggacagatatgccttgcagagcatcgtgatcagcacgcccaccatcgacacggcgacgctggattaccccgaaggcagcctgaagcgctttcagaacaccggggtcgaatcgcgctggcatctcgtgctgccggcggtgcttgaactgaggcgccacaagaacggcgccggccggaccagggcgtggcatgaggctgcgagccggcatgtccaggccctgaggccgcatctggacgatgtcgtgttcgaggtgaccttctcgggccgctggtaggcggttgcgaacgcccggcccggtcaggagtggccacctgaccaggcggggcgtgcccgttaccggtgccgcttgttcaccgcccgcgcgatccggtcacccaccgactgcaccagctggaccagcacgatcagcagcaccaccaccgcgatcatcatctcgggcatgaagcgctgatagccatagcggatgcccagatcaccgagcccaccgccgccgaccgcgccgaccatggccgaatagccgatcagcgacaccaccgccagcgtcagcccgtgcacgatgccgggcatggcctcgggcagcagcaccttcagcacgatctggatcggcttcgcccccatcgcctgtgccgcctcgatcaggccgcgatcgacctcgcggatggcaccctcgaccagtcgggcgatgaaggggatggcggccaccgtcagcggcacgatcgcggccgaggtgccgatcgaggtgccggcgaccagccgggtgaaggggatgatggcgaccgccagaatgatgaacgggatggagcgggtggcattgaccaccgcgcccgcgatccggttccaggccggtgcgccgtaaagttcgccccggccggtgaccgccaccgacacgccgatcggcaggccgatcgcagtgccgatcagggtcgcgaccgccaccatataggcggtctcgccggtcgcgcgcagcagcaggtcgatgagctggggcgggaagagctgatcaagccactggaacatgagccgtaatccgtgcatcgaggccgaggccgttgatgaaatccaccaccgaggcgccggcggcctcgccgcccggcacctcgaccagcatcaggccgaagggcttgccctggatgtattcgatgcggccatggaggatgttgaccgccaccccgcgttcggtcgcgagccgggcgatcgccggctcgaaggcggcagcccccttgaacacgatccgcaccaccgcattgcggtcgccacccgtggcggcgccctcgtcgaaccggcgcttcagccctgaggggatggcaaggtccacttcgctcgacacgaagctgcgggtggtcgggtgttcgggcgcggtgaacacgtcgtagaccgggccctgttcgatcacccggccggcttccatcaccgccacgcggtcgcagatttcgcggatcacccccatttcatgggtgatcgccaccaccgtcagccccagccgccgcttcagatcggcgatcagggtcaggatctgctgggtggtctcggggtcgagcgccgaggtgatctcgtcgcagagcagcagccggggctcgttcgacagggcgcgggcgatgccgacccgctgcttctggccgcccgacagttccgacgggtagcgcccggccttgtcggccagacccaccagctccagcagcggctccaccttgcggcgccgctcggccctgccgactccggcgagttccagcggcagcgccacattgtcgaacacggtgcgcgacgagagcaggttgaaatgctggaagaccatgccgatccgccgccgggccttgatcagcccggcatcgtcgagcgcggtcatatcggtgccgtcgaccgtcacccggcccgtgctcggccgctccagcaggttgatgcagcgcaccagcgtgctcttgccggcaccgctgcgcccgatgatgccgaagatttctccgggctcgacccgaagatcgatcccgtccagggctgaaacggcggtcgcggtgccgcgggcggcataggtcttcgcgacagcttccagcgtgaccatggcggtcatgcgcgcatgtccttccgtcatccgttgcgcggatcggacggcaggcggccgcaatgcccgcgacaggatacggaaaacccgcgggcggagcggctgccggcgggtcgatccgcctctctttagcggcatttgtatgggcgccccgcaagctgaagcctcaaatcggcgccattggccggaggataatcagcgttcttcgatgttgaaaggaaagaatgcgcatgagcggcatgtgaatgccgcatggtggaccgcgggggccggatgtgcttcaactccgcccatgggcagccggagtcaccggcgcgcgatccagaggatcgcatcgctgacgcccgcagcaacgaggacaagatgagttacacggtcaaggagctgttcctgaccctgcagggcgaaggcgcacaggcgggtcggaccgccgtgttctgccgcttcgcggggtgcaatctgtggtcggggcgggaacgggacagggcaggggccctctgccggttctgcgacaccgatttcgtgggaaccgacggcgacgggggcggacgcttccgcgacgcacaggatctggcggcggccatcgagggctgctggggcggcggccgggcgcgccgctatgtcgtcttcaccggcggcgagccgctgctgcagctggacgaggcgctgatccacgcggtcaaggcccggggtttcgagatcgcggtggagaccaacggcaccatcgcggcccccgagggcatcgactggatctgcgtcagtcccaaggcgggaaccgagctggttcagcgccgcggccacgagctgaagctggtccacccgcaggcggggctcgatcccgccgcgctggaagcgctcgatttcggggtgatgtgggtgcagcccatggacgggccggaccgggcggtcaacaccgaagccgcggtcgcctggtgtctcgcccatccgcgctggcgcctcagcctccagacccacaagctcatcggaatcccctgatgttcgagctttccaagcagttccgcttcgaggcggcgcacaccctgcatcgcgtgatcgatgccgagcccagccgccgcattcacggccattcctaccgcgccgaggtggtcatccgcggccgccccgaccctgtgaccggcatggtgctggatctgggcctgttcgaacgcgccctggccggcgcccgcgacgggttggatcatcgcctgctcgacgaggtgccggatctggggccggcgaccatggagaacctggccgcctggatctggcgccgtctcgccggccagctgcccggcctcgcccgggtgaccgtccaccgcgacagcaccggcgacatctgcacctgtttcggcccggatgccggcagcggggtggcggcatgaccgggtctccgcggaatgccggcgcgctggtcctgttctcgggcgggcaggacagcgccacatgcctcgcctgggcgctggaccggttcgaccgggtggagacgctgggcttcgactatggccagcgccaccgggtcgaactcgattgccgcggcaccctgcgcgagcggatggccgcactcgacccgcgttgggcggcacggctcggccccgatcacaccctcgatctgggcgtgctgggcgcgatgtcggaaaccagcctgacccgcgaggtggagatcggcctgcgggaggacggcctgcccgacaccttcgtgcccggccgcaatctgctcttcctcaccttcgcggccgccctcggcttccggcgcgggctcgaccatgtcgtcggcggcatgtgcgagaccgattattcgggctatcccgactgccgcgacgatacgatcaaggcgctgcaggtggcgctgaacctgggcatggcgaaacaattcgtcctgcacacgccgctgatgtggctggacaaggcggaaacctgggccttggcccagcggctgggcggtgcggcgctggtcgatctgatcgtcgccgagagccatacctgctatctgggcacgcgcggcgagttgcatgactggggccatggctgcggcagctgcccggcctgccgcttgcgcgcccatggccatgcgcgctatcgggaggccctgactttggatggccggatgccggccgcaggatgacggaacgaccggaagggtgacggagatggagatgcggggcttcttcgcgatcgggctggaggcggtgacgcggccgatgaatgccggcacgctgttccgcgccgcccatgccttcggtgcctcctatgccttcgccctctcggacgaccgcctgggaaggcgggccgcccaggccgacacctcggcctcggcccgtcatctgccctttttccgctttgcctcgatcgacgctctgccgatgcccgaaggcgcgctgctgatcgggttcgagatcgacgacgcgctcgacaccatgccctacatcccccatcccgatcaggcggtctatctgatcgcgccggaagtggacgggctttcggcggccgcgcgcagccgcgcctcggccgtcatccgcctgcccggccgcctcgccctcaacccggccatggccggcgcgctggtcatgtacgaccggatgctgatccacggccgctcggccccccgcccggtggcatcgagcgcggtgccggggcggcatgggccgcgtcgagagtgatggctgtccgcatgcagggccttcctctccttccatcctcctgatgttcttggtatgttttcgatctaacgtaaaacgttcattttgtccggaggcatcgcccatgtcggaagcggaatggcgcagggcagcggtgaaggactgccgcaccagactggcagccgccatagaagaggggctggaggacgagcgcctcggccgcctgtacgatattgaggaggttcttgaggaattgctggcacactacgacgccatgatcgccgctcgcatccccctcacaccccctcccgcaacagaaacttctgcagcttccccgtcggcgtccgtggcaggctgtcgaccaggcggataatccgcgggatcttgtagcgggcgagggcggcggtgcagtgggcggtgaccgccgcttcgtcgagggcggtgtcggccttgggcacgatgaaggcggtcaccgtctcgccccattcctcgtgaggggtgccgatcaccgccgcctcggcaatggcgggatgggcggcgagcacatcctcgacttccttggaatagacgttctcgccgccggtcacgatcatgtccttcagccggtcgacgatgaacagatagccgtcgtcgtcgatccgggcgagatcgcccgagcggtaccagccgtcatggaaggcggcggcggtggcctcggggtcgttgtgatagcccagcatcatcgactggcagcgcatccagatttcgccggtttcgccggggccggcctcggtcacctcgtcgcgcatgaccttgaggtcggcgcctgccacggcataacggccgatcgagcccgccttggcgacctgttcctccggatagagcgccgtgccggtcgggccggtctcggtcatgccgaaaacctggtagaatcggtccgaccggtagcgctccgccagcatccgggcggtgaccgcatcgatcggcccgccgccatagatccaggcccggacgtgggagagatcgaagctgtcgaaatgcggcagcatgcgcggcggcatcaggaaggcgatgggcgccccgaagaacagggtgcagcgctcctcctgcatggtctggacgaaatgcagcggatggtattcgggcagcagcaccaccgccgcccccacatagaccgaattgatcagcatgttgttgagcgggaagctgtgccagaccggcatggccagcagcacccggtcggtggggcccagcccgtaaaccaggctggagcccgtgccggcgagcagtacgttcgcatgcgaatgcaggcagcctttgggccgccccgtcgtgcccgaggtgtacaggatctcgaccggctctccggcatcgagcgcgaccggcgccggtggcgcggccggggcagggccggcgaagagcccgccgtcgccgtcatcgagcatcagcatgcgggcagctcccgccgccgagccgtcgccggccagatcgcgatccaccagccagagcgtcgcgcccgaatgctgcaggatataagcggtctctggtgccgccagcttgtggttgaccggcacggtgaccgcccctgcgcgcaccgcgccgaagaaggccaccacccactcgaccgtgttgcggccatggatcgcaaccgcatcgcccttcgtgatgcccgccgcctgcaatcgggcggcggcatcgtcggccgcggcgtcgagatcggcgaagctcagccgccgaccgccgccgaccagggcttcgcggccggcaaatttgcgggcggcgctccgcagcacatcgtccagcgtccacattcttgcgtttcctccggggggcggccgttcgggccgtgatgatcgggacaatgtcctcaagggacgcgacagcgcaggctcaaccggcaccgctgtgtggatggggtcccaatgcctgaacgcagaagcgcgcaatcgctgcgcccagccgggcgtctctttccgggtctgcggccgatgcttccgggggctgggtcagggggccggccatggcctcggcaatcgcaccgacgatcgcggcagcgacgatgtccgcgtcctgtggtgcaatctcaccgctggcgatcccttcacgcacaagttgtgcaaatatatcgcgatagggctggcgatagcgcagccgttccgcttcgatcgccggatccaccggctcggcgagcagggcccaggcgaggcgtggtcccttcagggcccgtcgtgcgaaggtttcaaccacgccggccagtcgctcgcgcgcggttcccggctgggctgcgcgccttgcgcaggcatcgatctcgcgctgactggccctgcggaacacctcttcgaacaggtcggccttggagggaaaataccggtagagcaggccggtcgacacctcggccctggtggcaatggccggcatgctggcagccgcatagccgcccgacgcgaccagcgcgagggctgcggtcacgatctcctcccgggtgcgggcaagccgctcctccatcatttttgtgcgccggtatgccattcttaaaaattgaaccacctttcatttcttattgcaagcgcctgaggccgtgctctatggttgctgaaattataacgaaaagaagaaatgcatacgagttgacgaaacgatcgcgttcgtatgcaatcaagtcgaatccggtatgtacggatggtgtgtcgggcgggagacgtgcctcgccgtcccatctgatgatcgtcaagggcatccgcccgacgcgatcggcgggggggggggagcgtctcccgctctccgggtcaggcccgcgaagcccgcagggccgggcctgacatgccgtcgtcaaagtcatggacatcgccgacatgctcgaatcagtcgatggcgacagtgtcttcctgtggcgtggggaaggcgaggtgctgcccaccatcctcgcccgtggtccatggagcgagatggctcagcatgggggcgcgccggcggccctgctggttcatgctgcggaaagggccctcggggagccggggtggctgctcagccgcatgacgctggaactgctgcgcccggtgccggtggcccccctgcgtctggtgatccgcggccggcgcggccggtcggtgcgtcgcgccgacatggcgttgatcgccgacgggtccgaggttgcacagggcgtggcggtgctgatgcgcgaggaagccatagacctgggggatccggccgttggcggtccggggctgccactgccggccagctgtacggagcctgtgcggatcccggggatgccggacacccgttcatttcattacacggccatggaatcgcgggtggcggcaggctcggtggctcgtcccggccctgcggcggtctggtttcgtctggcggtgccgctggtcgagggggtggagaactcgccagccatgcgggtgatggcagctgcggatttcggcaacggcatcagctgggtgctgccgcccgaccggttcaccttcgtgaacaccgatctgaccgtccatctccaccgcgcgccggtgggggaatgggtgggggtggatgcgaccaccgtcatgcagccccatggggtggggctcaccacctcgcgcctggtcgacgagctgggcgagatcggcatcgccatgcaggggctggtggtccgccagcgggcggcggcggcctgacgatacggtcagccagggttccgtcttcaggcgagcacgatccgggtcccggcctgttccgccgcctcgctcagatggcggggtggggcgcggtcagtgaccagccggtcaatctccggcagatccgcgatccggaccggggcgctgcgggtgaatttggacgccgcccccaccgctaccaccatgcgggcggcgcggatcatcgcctgttttgcggccaccttatgcaggtcgaaatccatcagcgcaccggtttcgtctatccctgagaagccgatgatcgcgacatcgcagcggaagcgcgcaagccccgcctgggtggtgtcgccgatcagcgatccgtcggggccgtggatgctgccgccggtgacgaagatttcggaccgggggccgttttccggccggcccgccgccagcagcatcgccgcgggcagactgttggtcacgatggtcagcccgccgcgcgccgtcagcgcgcgcgccacggcttccaccgtggtgccgacatccaggaagaccgcggcaccgtcgggcaccagttcggccgcgcgccggccgatcgcatccttggcgtcggtctgactcagctgcttttcggcatagggcgggcggaccgccggctccaccacgccggccccgccatgaaagcgttgcagcagtttcagcgcatccagccggatgatctcgcgccttatggtctgggccgagacgtcgaactgccgcgccagcgcatcgatggtcgcgaagccctgctcgcgcacgatgcgcaggatgtcgtactggcgctggctcaccgcctcgccgctgtccaggatcacgttctctccggtcggcacctgccgtgcatccttcgtcaccgatggcgtcgccacactggacggcgacagaattggaagataatttacaacgacccccgccgggccgcgagcccggttccgttccgaccggagatcttcatggaaccgtcgctcttcgtggcagaaggcaggctgtggcgcaatgatgatgcgcaatgccgggtgttcgacccctggtccctgatctggcagccggccgatgccctgccggcgggcgcccgggcgatcacggccgaggcggcgcttgccgaactggctgccgccaaccgcatccgccgcctgccggtcgcggtgatcggcccgcgcgaaccggtgggcgatcaggaagccgtggctgccgccatcggggccgcgatcgcctcgctcggcctggttctgctcaccggcggcaagggcggggtgatggccgcagccagccgcggcgccgcggaatccggtggcctggtcctgggttacgtgccggatgaagactggcggatggccaacccccatgtcgccgtgccgctcgccaccggtatcggtccggtgcgcaatgcactgatcgcgcgcgcctgcccggtgctgatcgcggtcggcggcggctatggcacgctgtccgaaatcgcctatggcctgcatttcgacaagctggtgctgaccatcgccgacgcgccggtggtggatggcgcgatcatctgccgcgatgtggccgagatccgcggccgcatcgcccggcgcatgctcgcccttgacgcgacgctctgaccggccctgccgccgcgtcgcgcccccgtcgtcgttctgccacctgatctgtaatcaaacgatcattggtggccggaatggaagaaaacgataatgcgccggtctcgccccgccggtctcatgtccggtgacccgggcgtggcggggtttcccggcaccggacggtttccatggcgctcgtcaccgcatgctacctgctctatctggcggcgccgatcgcgctgctggtgctgggctcgttcggcgacagctggaccggcacgctgctgccctcgggtttcaccacccgctggtatgaagatctgctcgccgatgccagcttccgccgcgccttcttcaccagcctgaaggtgctggcggccacggcggtgatcgatgcgctgatcgccgtgcccgcagcctacgccatccattccgccgccagccgcggcgtgcgcaccgcggcgcgcatcgcctcgctgatgccggtggccgtgccggaactggtgctgggcttcggcttcatcctggtgttttcctcttcgaccctgccatggctcggcaccttcgagctgctggtggcggcccatgtggtcctgaccctgccctatctcatgaacacgcttctcgccgacatgcagacgctcgggctcgcccggatcgaggccgcggcggcaacgctcggcgccggcttccgccatcgcttcgtcgatatcgtgctgccgtcgctgcgtcacagcctgacctcggggctggtgatggtcgccgccctctcgatcggcgaattccagctctccaacctggtcgccggcttcctggaccggacctatccgatcgtgctgctccaggccttctacggcgccaccggctttgcctgtgccgcgaccgtggtgctgctggcgctggcgacgctggcggccggtgcctcggcacttgccgccgccggcggccggcgcgcccgggcgggagggtgatcccatgagcgtgcatttcgacgccgtctcctttcgttatccctcaggtggtgccggtgtctccgacatcgatctggagatcggcgatggcgagctgctggcggtgatcgggccgtcgggctcgggcaagaccactctgctgcgcctgctttcgggcttcgtggtgcccgatcggggccggatcctgatcgacggccgcgacgtcgcccgggtgccggtcaaggaccgggcgctgggcgtggtgttccaggcctatgcgctgttcccgcacatgaccgcggccgagaacgtcgcctatccgctgaagctgcgcggggtggaccgtgccacccgcatggcccgcgcaagtgaggctctggagaaggtcgggctcggcggtttcgcgcaccgccagccggcctcgctgtcgggcgggcagcagcagcgggtagcgctggcccgggcgctggtcttcgggccgcgggccctcctgctcgacgaaccgctgtcggcgctggatgccgggctgcgggccggcatgcgcgacgagatcctgcgcgtccagcgcgcggccggcatcgccaccctgttcgtgacccatgatcaggaagaggcgctgtcgatggccgaccgggttgccgtgttgaaggatggccgtctgcttcaggtcgacacgccccgcgggctttacgagcggccggtggatgcgaccgtcgcgggcttcgtcggccatgccaatctctggtccggccgggtggcggccgacgggctggtcgagaccgcgatcgggccgatccgcacggccacgggcggtttcgccccgggcgatgccgtcaccgtgatgatccgcccggaagaggtctcggccgagcccgccgcagatgccgccaaccgcttcgccggccggatcgcggccgatcgtttcctcggcaatctccgccgcctggacctcgaagttccgggtgggctggtgaaggtcgagacccgccgtcgcgatgcgatcgatacggtcgccatcgcgcccgaggccgtccggctgttgccggccggtctctgaccgtcaccgtctccctgcacgctgatcccccagcacccgcccaacagcaccagtcgaacgggaccgatccgatgaccatgagcttctggaagaagacggccgccgccctgatgatggcggccggcaccttcgccgccaccactgccctgaccccggccttcgcccagccgctggatggcggcgagctttatcagggcgagcaggccctctacgacgccgcgcgcgacgaggggctggtggtctccttcgacaccggcccgacctgggcgaactgggccgcccagttcaaggcgttcaaggcccgctatccgggcgtcgagatcgtctataacgatcttggttcggccgcgaccgtggtggcgctcgacaagtcgcgcaaccggccgcaggcggataccgcctattatttcgcgggttcggccctcgatgccgccgagaagggcgtcgtcgccgatttcaagccggtgaatttcgaccgtctgcccgaacccttccgtcatccggccggccagtggttcaccatccacagcctgaacgtggccttcctggtgaatacgaagctggtcaaacaggtcccccagagctgggccgatctgctgggcgaggcctatcgcaattcggtggtctatctggatccgcgcacggccgggcagggccaggtggtgaccatcgccgccgccttcggcaatggcggcagcatggacgacgttcagccgggcatcgactatctgggccggttgcacaaggccggcaacgtgctgcgcaccgtcggcaccacgccttacgcccagttcgtgaagggcgagatcccgatctggatcggctacgagaatgacgggctgaaggccaaatatgtcgacggcatgggcgacgacgtcgcggtggtgatccccgccgaggcctcggccgcggccccctatgcgatcagcctggtcaaggacggtccgaacccgaatgccggcaagctctggctgaactacatcatgaccgacaagggccagaccacctttgccgagggcttcgtgcgcccgtcggtgccgggtgtgaagctgcccgacgaggtgctggccaagctgcccgaggcgccgcagatccgcccggtggatgtcgccaaggcgcgtgacgccaagcccgccatcgatgccggctggtcgaaggccgtgctcggccagtaacctgcccgcgcaacctgcccgcgccctcacgcctgatgcggcacggtgccggccgatccggtgccgtgcccgccggcgttttcaaccgtctctcttcttcaggaccagccccatgaccttgccgccccggctcctgatcctgctgtcgctgccggcgctcgtcacgatggcggtgtttttcgtgctgccgctcgccgtgctggtgggggagacgggcgaggggggcggtgccgcctatctcaggctcgtcgacgatccggtcttctggcaggggctgaagggtacgctggtgctgggcacggtcgccccggcgctgtcggtggtggtcggcttctgcgtggcgctgcatctggcacgcctgcccgagggcaggcgccaggggctgctgtttctgctctccctgccgctcaccttctcagggctcatcgtcgcctatggcttcatcctggtcttcggccgcgcgggctttttcaccctgctgctggccgaactgggcgccgatccggcggtggtgggggcgatgatcttcacgccggcggggctcggcttcgcctattgctattacctgatcccgcgcgtggtgctggtgatgctgccggtgctggtcaatttcgacacgcgccagatggatgcggccgaaagccttggcgccggccgcttcgccgccttccgcgacgtgctgctgccccaagtgaccccggcgctgatcgccgccttctgcctgaccgcggcggtggccatcggtgcctatggcacggcgctcgccctggtcggcacccaggtgcagatcctgccgctgctgctgttctcgaagatctcggaaaccggcgccgacctgccggcggcggccgcggcttcggtggtgctgatggcggtctgctgtgcggtcatgggcctggccgaagccctgggcgggctccggcgcagggggtgattcgtttgtccctctgcccaagcgggcgctggcgcgcccttggccgccgccgcaatggcggcttgcaccagccaccctcgggtggctggtgcggaacgatcagcgataggggaagccggccttctccatcagggccgaataatccttcaggatcttgaccaccttgccggcgcgcgggctggtcgcggcgatctcgtcccagaactgttcggcgtccttttcgacctgcgaccattcctcgcgcgggatcgaggtcagctccatcttcttgccgttgacgcgcagatcggcctcgccgccccagtaccagacctggcggtagtaatgcgactggtcgatcgtggtcaggaacagctgcttcagatgcggcggcaccttctcccagctcttgctgttggcgaaataggacccgcaccaggcgccgcagatattgttggtcagcgcgtaattgcagacatccgcccagcccacctcataggcctcggtgaagccgcaccaggcgacgccgtccagctggccggtctggatcgcgacctcgacatcgtcccagggcacggtcaccgggatcaggccgtagcgcgacaggaacttgccggcggtcggcacgccgaagacgcgcttgccgcgcatatcggccagcgagcggatcggctccttggtgaagacatgcagcggatcccaggcgccggccgacagccattccacgccgtcgatctcgtcataggcttctttccagatctcgttcagcccatagcgctggaacagcaccggcaggtccaggctgaagcggcaggagaaggggaaatagccgccgaacaccgccacatcggcgggcgaggccatggtcgcgtcatccgactgcaccgcatcgatggtgccgttctgcagcgcgcggaacagttcggcggtcggcaccagctggtcggcgtaatagagttcgatctccatctcgccattggccgccgcattgaaggcctcgatctgcggcttgatcacatgggcgccaagcggtgcgcccgaataggtctgcagccgccagcggatcttggactgggcatgcaccgccggggcggcgaaggtggtgctggccgccagcgccgcgccgccgatgccggcggtcttcaggaactgtcgccggcttcccgcgaccggatcggccgaggacgtcttcttctcgatgtcgctcatgtcgttcgtctcctggaagcggtgcgcatgtctccccatgcgcccgccatggccgtgtcgggggtgtgggtgaagactactttccgtagacgaggttcggcagccagagcgcgatcccggggaagaccatcagcagggcgatggtgatcaccatcatgatcacgaaggggatgatcgacttgtagatgtcgatcagggtgatttccttcggcgccatcgcccgcatcaggaacaggttgtagccgaagggcggggtgatataggcgatctggcaggtgatggtgtagagcacgccgaaccagatcacgttgaattccagcgccttgaccagcggcacataaagcggcgccacgatcaccagcatggcggtgtcgtccaggaacatgcccatcaggatgaaggaggccatcatcatcgccatcacctgccagcgggtcagttcccagttggtgatgaacagcgattcgatcgcccgcgccgcgccgatgccgtcgaacaccgccccgaaggcgagggcggccaggatcagccacatgaacatgcacgagatcgacagcgtctttttcgacgtctccttgatcaggcgccagttcagccggcccttcagggcggcggcgatggtcgcaccggtggcgccgatcgccgagctttcgaccaggctggtatagcccatcacgaacagccccatcatcgtgaagaagatcacgaaggggatgaggccggcgcgcagcagcttcagcttctgcccgatcggcatgttcagttcgtcgtcggtgacggtgggggcgagtgcggggttcagccggcagcgcaccacgacataggcggtgaacatcgccgccatcatcagccccggcaccatgcccgccagccagagctggcccaccggcgcccgggcgatcatgccgtagagcaccagcaccacgctcggcgggatcaggatgccgagcgaggatccgccctggatgacgccggtgatcagcaccttgtcatagccccggcggagcatttcaggcagggcgatggtggcgccgatagccagtccggctacggaaagcccgttcatggccgaaatcaccaccatcagcacgatcgtgccgatggcgagcccgccccgcagcctgccgaaccagacgtggaaggccttgtagagatcttctgcgatgcccgcttccgacaggatgtagcccatgtagatgaacaggggcagcgtgagcatcgggaaccagttgaacagcttcaacgtggcattgaacggcatctcgacggcgccgttgccgtagagcagcagggcggcacccgccgccacgaagccgatcgcgccgaagacccgctgcccggtgagcagcatcagggccatcgtcgcgaacatcaggatcgcgatcagttcatagctcatacggcatccacccggcggatcgtcgcgatgtgtttgaacaccagcgacagtgtctggagcagcatgatcaccaggcagaccacgagcagcgccttgatcgggatcatcgacgggttccacatcgagaaccggcgctcattggtctggatggcgtattgcaggctcgacaccgagccgatggtcatgaccaccaggtagaacatcaggcaggccgaggtgatcaggtccaggatcgccttgccgcgcgtggaaagatgctgatagatcaggtccatgcggacgtgatcgtcattcttcagcgtcatcgcgccgcccatgaagaaataggcgagcagcgtgaactgggcgacctcgacacaccagtgcagcgggatgtcgagcgcgttgcgggtgatcgcgtccagcagcaggacgccgatcatcacgaagaccagagccatcgccacgatgccgacataatcggacaatcggtcgacgacccgcacataccatctgattgcagccggcatcggccagtccgtcccccgtctcgtcaggcggccgccccctccccagtggccggccgcccgggtttgtctagatcagctcggctcccgccgctctcagggcggcttcatgtatcgcgccgggcggcgcatcggtgacgacggtgtccacctcgtccaggccgcagacccggaaggccgccttgcgcccgaacttggcccgtgccgccaccaggatcaggctgcgcgcattgccgatcatggcgcgcgcgacctgggcttcgtcgaaattggaatccatggccccgacttcggcatcaatcgccgccaccgtcaggatggcgtgatcggcctggaagtcgcggatctgctcgatcaccagcgggccgaccgtctggtcgttgtcacccatgaaggtgccgcccagcagatagacccggcccggttgcggcgccgcgccgaagacccgggcgatgcgcagcgaattggtaatcaccgtcagcccgccgatgcccgccagcgcctcggcgcaggcgagggttgtggagccggtgtcgatgaacagcgtgtcgccgggctcgatcagcggcaccagccggcctgcgatcacctgtttcgcctcggcctcttcggccatgcggtccttgaagctgccctcggcatgaagcttgggccggcgggcaccgccatggaccttctggagcacgccgtcactggcaagcccggccagatcgcggcggatcgtttccgccgaaacctcgaaagcctgggcgagcgcgtcgaccgacatctcgccctgctgccagatcatgtccgcgatccgcgcctgccgttccctgcgtcgcattcccgtcctccgttcatcaaagtaggacatcggccaatgcccgagtcaaggtgcatgtgccggcatgaatgcccgaacggtcataattttgtggtaaagttgaccgttcgggcattttagggcaggctgatcgcaggaaagacggccctgacccgcaggagaaaaccctgaaccgcaggaggacaggcatggccccggccggcgacgcattccccaacggacatgcggatggcaccttcgacgtcgcgatcatcggcgccggggtgatcggctgcgcgctcgcccgccgcttcacgctggaaggcgcccgggtggtgctgatcgagaaggcggccgacgtgctcgacggggcctccaagggcaacagcgccatcctgcataccggcttcgacgccccgcccggatcggtggaggcggcctgcatcgccgcgggctatcgggaatatcttgagatccgcgcgcggctgaacctgccgctgctgcagaccggcgccctggtcgtcgcctggacggatgaagaggcggcaaccctgcccgatctgatcgcccaggcccgggcgaacggcgtcgacgatgtcgagccgctgacggaagccgaggcccgccggctggagccggcgctggggccgggggtgcgcgccgccttccgggtgccgcgggaatatgtgatcgacccctggtccgccccccatgcctatctgcgccaggcggtggagaacggcgcccggctgatgaccgcggcccccgtcaccgccggggtgttcgacggcagcacctggcgcctggaaaccccgcggggtgccgtgcgggccgggctggtgatcaatgccgcaggcctctggggcgaccggctggacgatctgctgaccgggaccaccgatttcaccatccggccgcgcaagggccagtttgtggtctatgacaagccggcggcggcccttgccggccacatcctgctgccggtgccgaacaaggtgaccaagggcatcgtcgtctgccgcaccgccttcggcaatctactggtcggccccaccgccgaggagcaggaggatcgcgagcgcgccgggctggtgcccgaaaccctggaggcgctgatccgccgcggcaccgagatcctgccggcgctgaaggatcacgaggtgactgcgatctatgccgggctccgccccgccaccgaattcaaggactaccggatccgggtggaggcggcacggcgctatgtgaccgtcggcggcatccgctccacggggttgagttcggcactcggcaccgccgcccatgtccatcgcctggtggccggcctgcttgcgggccaccaggcgatcgccgatccggtttggccgcgcatgccgatgctggccgagcacgagacccgcgactggcaatgccccggcaatggcggcgtggtctgtcattgtgagcgggtgacgcggcgcgagatcgaggccgcccttgatggcccgaccggcgcccgcagcctggcggggctgaagcggcgcacccgcgtgaccatgggccgttgccagggtttctactgttccgaggctctggcggcgatcaccgccggccggctggcggtgccgatgacggccgatcccacgaccgccccacctgcagctgcgggagacgaggcatgaccgcggagcattgggatgtggtggtgatcggtgcgggcccggccgggctcgccgccgcgaccgagctgcgccgccagggcgtcgaccgggtgctggtgctggaccgcgaggccgaggctggcggcattccgcgccattgtgcccattcgcccttcggcctgcgcgaattccgccggctgatgaccggccccgcctatgcccgtcggctgatgcgcaccgccgcggccgccggggtcgagatccgcacccgcgtgaccgtggccgcgatccgtccgggctccggggcttccggccctgaactcgacgtctcgacgccggacgcggggctgggggtgatccgggcccggcgcgtgctggtggcaaccggcgtgcgcgagaccagccgcgcccagcggctgatcggcggcaccaagcccggcggcgtgctctcgaccggcgcgcttcaggggctggtgcatctggaccatctgaaacccttcagccggccggtggtgctgggcaccgaactggtctcgttctcggccctgatcacctgcgtccaggcgggcatccggccggtggcgatgatcgagcccggccagggcaccgttgcccgctggccggccggtctgttgccccggctgctgggggtgaaactgctgaccgggactgcgcttcggaccatcgaggggcgggacagggtcaccgccgtcaccctgcgcgatgccgacggcgctgagcgggtgatcgagaccgatggcgtcgtcgtgaccggcggcttccggcccgaggcgacgctgttcgccggcagccatcttgcccgtgatcccgcgaccggcggcccggtgatcgacgagttcggccgctgctcggatcccgcggtctttgccgcgggcaacctgctgcgcccggtggaaaccgcgggctggagctggaaggaaggccgtcgcaccggccgggcgatcgcgctcgacctggccggccgcctgccggccgccggcgggcttgcggtggtcgttgcgggcgcgccgctgcgctttgccctgccgcagctgatcgccggtggcaggccgggcctgcgggttcacgaccatattcagttccgggtcgacagccgggtggcggggcggctggtcctgaccgatgatgggcgggagatctggtcgcagcgtctgcgcagccggccggaacggcggatcctggtgccgatcgacgccctgccggtcgtgcggtcgggccgctacacgttcggctgggacgcgcggtgatgaccattcttgccatcgatcagggcaccaccaccacccgcgccgtgctggtcgggcccgatggcgggacgcggatcgtggcgagcctgccccatcgccagatccacccggcccccggccatgtcgagcacgacccggaagagctgatccggaacctccgcagttgcctcgatgcagcccgggcggcgggcgcgccgcttgcggtcggcatcgacaatcagggggaaagctgcctcgcctgggatgcggcgaccggcgaggccatctctccggtgctggtctggcaggatgaccggacccgcgacgtcgttgaccggctgcgcgccgacggggccgaggatatggtgctgtcgcgggccggcctgccgctcgatccttatttctcggcctccaagcttgcctggatcctgcgcgagatccctgcggcgcggcggctggcggggctggggcggctccgcctcggcaccaccgatgccttcttccgcgaccggctgaccggacggttcgaaaccgacgtcaccaccgcctcgcgcaccgcgctcatgaatctcgacagctgcgactgggatcctgagctgtgccggctgtttggcgtgccgatcgaggcgctgccgccgatcgggcccagcaccggcgatttcggcaccctggccggcaccggccttcgcctgaccgcaagcctggtcgaccagcaggcctcgctttacggccatggctgccggcaggcgggcgacggcaaaatcaccttcggtaccggcggcttcgccctggtggtgaccgaccggcggatggcagcggggcgagacggccccttgcccaccatcgcctggcagaaggcgggggaggcgccggtccatgcgctggaaggcggggtctattgtgccgcctcggcggtgaactgggcgcaggggctggggctgtttgccggccatgacgatatcggcgccttcgacggcgccccggccacgctcgacgggccggtcttcgtgccggcgctggcggggctcgcctgtccgcattgggaccggcgggcgcgcggcgcctggctggggctggggctcgataccgggccgggccggatgatgcaggcgctgcttgaaggcatcgcgctccgcatggccgaagtggtggcggtgatcggccgccatcagccgctcaccgacccggtaccgatcgatggcggcatggcggccaatgcctatttctgccggatgctggccgattgtctggaacggccggtgatcgtctccgacgagccggagctgaccgcggtcggcactgcagccctggccgccgaggtggcgggggtggcggtcgccaccccgcgccgcggccggaggatcgacccccggccgctgccgtccggtctgcgcgcgcgtttcgatgcggcgcgcgcggcggttcaggcttttgccgccgccggctgaccgcgaccgaagaccagcccgatcccgcccaggatcgccgccatgccgcaaagcgcgagcggggccggcaccgtgccgaagaccgcgaaatcgagcagcacggtcccggccggcaccagatagaacaggctggtgacgttgacgagatcgcctgcccggatcagccggtagaacagcagctgggcaccgaccgagatcaccagagcgagccagagcagcggcagtaccacggccggcacggcgtcgaaccgcaccgcttctgtcggcaggacgatcaggcagagtgcgagggcggccagatactgcaccggcatggccgtgagcgggtcgatggtggaacgcttctggagcagggcacctgcggtcatcgcggccagtgctgcgagagcgaggccggcgcctgccggggtgaggctggcggcggccaggctctgccagaccacggtgacgagccccgcgagggcgagtacgagccccgcaacccggcgccgactgcgcgcgcccccggtcatcaccagggtcagcaccggctgcagccccatgatggtggcgacggcgccgggcgtcatgccctgatccatcgccgccatgtagcagacggcataggcgccgaccagcagcaggccggtggcaagcagccgcggccaggcctgaagccgcggccagcgctgcccctgaaggcgcaggatcatcgtgatggcgagcagggccagcgcaaagcgcaggctgaggaaggcaagcgggctcgcatgatcgagcccgagccggatgaagatggcgccgctgctccacaggcagacgaacgccgccgtcgggccgaaatggcccgcggcacgaaggaaaccggtcatcggatctggaaaaaccgtctttgccggatgtcacgacaaccctgccggcccggctgcatcagccgtcagccgggaccgatcgaaccgtatggttcaggatccgaggggcggggtcgtgaaaaggcggccgccggtcaggcggcggcgcggccggcgggcggcggcggggtgccggcccgggcaatggccggcggggggacgacgcaggacatcatgtgcggcaccatggcggtcatgatcggtcgccccctggacggttgcaggatcgggtgaagtattcggccaagtatggcggcgcgcgggccgtgcatcaaccccgttgcgcggcttcccaggtgttgacgatccgggtcatgctgcgcagcaccggcttttcgatcagcttgccgtcgaccaccagcaggccactatcggcggcggcgaaggcgtccagcaccttgcgggcatgggcgacggtggcgtcgtcgggggtgaagacccggttgatgtgcgggatctgcttcgggtggatggtgcccttgcccgaaaaaccgaggtcggccgcggcctcggcctcgcggatcatgccggcctcgtcttccaggtcgagccagggcacgtcgatgacgtcgacaccggcggtggccgccgcgtggacgacgcgcgagcgggcatagagcagggcgttccagacattgcggcagcgcagatcggcggccatgtcgacgccgccgaaaaacagcgcctcgatccgctcgctggaggtcgcgatctcgaccgcggcttccaggccctcattggtctcgatgatcacatgcagccgggtggggcgctgatactcgtccagcaggtcggcgaggttgcggacctcttccggccctttcaccttgggcagcatcacggcaggcgccgggcgctccgcctcgatcagcgccttgacgtcggccatgccttcgggcgtgcgcaggcagttgatgcggatgatccgctccacccgcgggtcgccttcggtcaccggcacataggcgaaagccctgtcgcgcgcctcgggcttgtccttcggcgccaccgcatcctcaagatcgacgcagacgatatcggtgcccgaggccagcgccttggggaacatgtccggccgggtgccgggggtgaagatgaagctgcggcgcgactggatgcgggcgggggacatggcggctcctgacgggatggtcgggcgatcataggcgcgggcgcagaccaccgcaaaccggcggtccgtgacgtgaaccccctgcacgccctcttgtgcccccgtcaccagaccggcggggtggtgatccagagaatccgggtgcggccattggcgaggttgcggaatttgtgcggcgaggcgctttcgaaatggaaggcgtcgccctcgcccaggcggtagaccgcaccgtcgacatacagctccagccggccttccagaaccacgccgcattcctcgccttcgtggttgtaggcatcctcgcctgatccgccatcgggatcgagggtcagctccatcacctgcagcatgccctggtcgtggacggtcaggaattccttcaccatgcccttgtcgccgaaatcgacccggcggcgctggccggcgcggacgatgcgccgggcctcgttgttcggatcgctttcgccgccgcccagcagttccagcaccggcacgtccagaatggcgcagatcgccctgagcgcgcgaaccgagggcgaggagatcccgcgctcgatctggctgagaaagcccaccgacacattcgcggcatcggccacctgtttcagcgacagcccccgcgcctgacgcgcccggcgcacggcgaggccgaggctgagatcgtcctcttcagtcagtggctcgacgacgggcatctcggggatcgacgccgggggcgactcagggggtgtcatcggtggtggataccttcaggttcactctgttgaaaggagggccatattttttcacgaatttccagcccgaccatgcgttccgcaacgccccgaccgccggtgaccaccgcggcaggcgaacggaatcgcctgtcgtgcaggccttttcacgaaaatgaaatcggctgaccaatttcattgcgcccctcgataatttcactacgatgaaaatcagtcaacgccgaagccgatccgcatcgcagggcgggggtctgcgccaccagcacgggactgccggtggtgtgcgtggttgccggggggagcccggcgccgcgctgccctgcgatggtcggcaggacaacgaacaggggaagtttcatgaggctgaagacgcttgctgccgcaatcacggcactggccatcggcgccgtggcgccggctttcgcagcagagacggtgaaggtgggcgtgaccaccaccggcgtgcccttcaccttcgtcgacacgtcgagccagaagccgaccggcgcgatggtcgatctggcccaggcgatcggggccgaggcggggcttgccaccgaattcgaggtggtcgccttctcggcgctgatcccgtcgctgaccacgggcaagatcgacctgatctcggccggcatgctcgccaccgacaagcggcgcgaggtcgtggatttctcggccccggtctacacctatggcgaggcgatgttcgtgccggccgacgagccggcgaactacacgctcgacgatctgaagggcgccaccatcggcgcccaggtcggcaccaccttcgccgacgcgctcaacgcccgcggcaccttcggcgaggtgaagctctatgacagcatcgccgacatcatgcgcgatgtgaaactgggccggatcaaggccggcttcggcgacaagccgatcgtggcctatcagatcgcgcagaaccccgggatcggcctgcgcctggtcgatggctatcagccgctgaaggccggcgatgtggcgctcgcggtctcgaaggagaacccgggtctgctggagaaggtcaacgccgcgatcgcgaagctcaaggagagcggcgagcttgcgaagatcttcgcaaaatacgggctgtaagcgccaggcgttgcgaagatcttcgcaaacgcgatccggacgggtgccgggcggtgcggcagggcggctctccgcctgaccttcctcccgctccggcacgccactccccaccacccagggatcttcgatgagcgacttcctcagccgatccgccgactacatgccgctgctgttcgaaggcatgtggcggaccgtggcggtgaccctgctggcgctgtgcctcgccaccctgctcggcctggtctgggcgctgctgcggacctcgggcgtccgggtcctggcggtgccgacccggatcctggtcgagttcgtgcgcggcatcccgatcctggtcatcctgttctacatctatttcgtgatgcccgagatcggcctggatctcaccgcctttcaggccggggtgatcggtctggcgctcacctattcctgctatatcggcgagaccttccgcgccggtatcgaggcggtggacaagggccagatcgaggctgcgaaatcgatcggcatgcgccggccgctgatgatgcgccgggtggtgctgccccaggccttccggatcgtggtgccgccctatgctaacaatctggtcatgctgctcaaggacagctcgcaggtctcggtcatctcggtggcggagctgaccatgcagggcaagatgctggcctcgtccaccttcgacaacatgacggtcttcaccctggtggcgctgctctatctgtgcctgaccatcccgttgaacatggtcatgcgccgggtcgaacttcggatggggaaggcgcgatgatccgcttcgaggacgtgcacaaatcctatggcagccacgaggtgctgaagggcatcgatgccgaggtcgccaagggccaggtggtctgcctgatcggcccgtcgggttccggcaaatcgacccttctgcgctgcgtgaacgggctcgaaacctatcagcgcggccggatcaccatcgacggcgccctggtcgatgccgaggggcccgccattcacgggctgcgcacccgggtgtcgatggtcttccagcgcttcaacctgtttccccaccgcaccgcgctcgaaaacgtgatggaaggcccgatccatgtgctgagggagcctgcatccgaggtgcgcgcccgggccgaggcgctgctggcgcgggtggggctggccgacaagttccacgcctatccgggcgcactctcgggcgggcagcagcagcgtgtggccatcgcccggtcgctggcgatgcggcccgatgcgatcctgttcgacgaaccgacctcggccctcgaccccgaaatggtcggcgaggtgctgcaggtgatgcgctctctggccgatgaggacatgaccatgctggtcgtgacccacgagatccagttcgcccgcgaggttgccgatgcggtgctgttcctggatggcgggcggatcgtcgagcagggcccggcggcagaggtgctgcgcaatccgcgccatgagcgcacgcaggacttcctccgtcgcgtcacgcaccctgtttgagagtctgtatggccctcgccgggcgggtgctggcgcacccttggccgccgcctcaatggcggcttggcgctgcgcgccggggagtctgtatggccttcgccggggggctgccgcacccttggccgccgcctcaatggccggagtcgtttaggcccttgccgggcgggtgctgccgcacccttggccgccgcctcaatggcggcttggtcccgcactggggtgcgggacgagattgttgtctgagcatcgggggcatccatgccatccttctctcctgccgcttccgtctgggctgccactgcggcgtcggggcctgatctgcctgccattaccggcgagcggcgggccgatgtcgcgatcgtgggtgccggtttcaccgggctggtcgcggcgctgacccttgcccggggcggggcctcggtgatcgtggtcgatacggtcgagccgggcttcggggccagcggccgcaatggcggccaggtgatccccgggctcaaggacgatcccgacacgctcgaccgggtgtttggcgaggcgaccaccgcctttgccggcggcaccgccgatctggtgttttcgctgatcgacgagcttggcatcgactgcgacccggtgcgtggcggctggatccaggccagcgtgaaacatctgcacctgccgcggctggaaagccggatggcgcagtggcgggcgcgcggggccgcggttgagatgctcgatcccgcgggcatggcggctgcgaccggcgggcggggcttcgtcggcggctggatcgatcgccgcggcggcagcgtgcatccgctcgcctatgcccgaggcctggcccgggcggcgctccaggccggggcggagattttccgcgatgcggaggccgtgtcgatcaagcggggcaatggcggctgggttctgggtttcgcaagcggtgcccggctgaccgcggatcaggtggtgatcgcgaccaatggctataccggccggctctggcccgggctgaaggcgacggtgatccccgccaacagcatccaggtggcgacggcgccgctgcccgacgaccttcgtgcccgcatcctgccgggccggccggtggtctccgacagccggcggatcgcgaattatttccgcatcggccccgagggccggctgatgatgggcgggcgcggcgccttccgcgagccgcgggatgccgccgactaccgccggatcgaggcggcgctcgccagcttctatcccgaggccgcacgcctgccgatgggttttcgctgggccggacgggtcgcgatgacccgcgatcacctgccgcatatccaccagccgtcggcgggcgtcaccatggcgctcggctataacggccggggtgtggcgctggcgagcgccatgggccgggcgatcggcgctcatctgctggatggtgccaacccgctgccgctggcgctctcggccatcaaaccgatgccggtgcacggcctgcacccgctttatgccaccgcaatgatcgaggcataccgggtgcgggacatgctggagcgctgatcagccgcgcagctcgcgggtcgagccgccgaagcgcagcaggttgccatggggatcgtggatgtggaattcggtcatcccccagggcttgtcttcgatcgccgacaggcccggcacgccgcgggcgctgaattcggcatgcaggtccaggatctcgccgccgcggatatagcaggaggtgttttccggatagcgacgatcgtcggtcagccagaaatggatttccatccggttgcggcggacgagcagatagtcgccatggcgttcggcggcgaagcccaactggtcctgatagaagacctggctttcggcaatgtcgagcgaggccaggacggggatgcagatcgcggcgtcggtcatcttgcctccgcggatgggtggggggacaggatagccgggtgcgctcaggccgcgaaggcccggatcctgcctgcggccgaacgggtgacctccatctcgataccatagatcgcccgcagctgtgccggggtcatgatccgcgccggtatgtcgtcggcgatcacccggccggagtggagcgcgacgatccggtcggcatggtcggcggccatgttgatgtcgtgcagcaccagcaccgccgcgaagccacgcgtgcgggccagatcgcggatcagccccagcacctccgcctgatgggcgatgtcgagcgccgaggttggctcgtcgagcagccagcagcttgcgtcctgggcgatcatcatcgctacccagacgcgctggcgctcgccccccgacagggtgtcgacctggcgatcggcgaagccgccgataccggtgagggcgatggcctcgtccaccgcccggcgatcggcggcggagaaccggccgagcgcgccatgccaggggaagcggccgagggcgaccagctcgtgcaccagcaggcccggcgcggccggggtcgcctgcggcagcagggcgagatgtcgggcgagatcgcgggccggccagcggtcgagcggccggccggcgaagcgcacccgcccggtggtcggcgccgtctgccctgacaggatgtcgagcagggtggatttgccggatccgttatggccgatcagcgcggtgagcccctcgcatgccagatcgagggtgatatcggccaggatcggccggccaccggcggtgaggccgacgccgtccagggtgaagccgctggttccggctgccatcagccatccctccggggcgtggtgaggtcgaccatctcggtcacccggccgtccttcatgcggatgatccggtcggcggtgtcgaaatagcggtcgtcatgggagatcacgatcagggtccggccctcggccttcagcgcgggcagcagctcggtgtgaaagacgtgacggaaacccggatcctgatcggcggtccattcgtcgaacaccaccaccggccggcggtcgacccaggcatggatcagcgccagccgcttgcgctggccggtggagagttccgtcgtggagaagcggccgttcgcaacctccaccttcgtgccgagacgcaggcggtcgagatgtgtgccaagctcctcgtcgctgacccgggccccgggcatcacctcgtcgaagaggtgataatcggtcaggatggccgagaacatctgccggtaggcatcgcgcgtgtcatcctccacgggccggccaccgacgacgatccggccggcatccgggcgatagaggccgagcagcagcttgatcagcgtcgtcttgcccgagccgttatcgcccacgatcatggtgatccggccgggcgcgaagccgagatcgagcggccccagccggaaaccgggaccgtcttccgtggaggggaaggcgaaagcgagaccgtcgaggcggatctcgaccggttccgccggcatcgccgccgatgcggtggcgccgggctcggccgtggcgaaacggcccgacagctcgtcgatccggcggagcgcgatctgcatccgggtgatcgccggcatcgaggtcatgatctgctccaccgggccgcgcaggaacagcagcaggatgaggaagccggaatagacggcgggatcctcggggctgaaggcggcccaggccaaaagcaccccgatcaccgcgaagaccagcgccgagcccagcgcattggcgatgacgaagatcgcgatcgcccggccgttgatgcggcggatgtcggcgatggtcgtcagaatgtcgccatggatcttctcgcgccggggcttgtagatcttcagctccttggcgccgccggtgatggtggcataggcggcatgcagccggtcctcgccctcccgcgcctcgtcgaaaccgcgcaccgcccgccggcgggcgcggtactgcagccagccgccggcggccagcaccaggatcaccgcggcagagagtgccggcgacagccagatcagataggcgaaggcgccgatcacggtgatcgccgaaatcgcgagcggggcggcgacgaaggccacatcgctgatcatgtcgacatcgtggttcagcaccggcagaatccggttccggccccagccttccagcgccggcaccggtgcatcgatgatccgccgggcgagccttgcgcgcagatccgccaccacagcctggccggcggcgttggtcgccagatcggatgcggcgcgggccgcgaaggtgacggcggcgagcgccaggaaaccggtgacgaagcccgcgggcagcacgaaatcccgtgcgatggcgtcgttcacccggtggagcagcaggatggtccccgccgcggacaggccaccggccaggatggcgagggtgaggcggcgccagtggctggtgacgaggctggcgaacaggcttccagaggtcatgagcgggtctcggatcggcgccagtaaggcacgcagagctgacgggcccgcggcagggtggcgagcaggggtttgagggtctggagctggtcgaactcacccgcgatccagacgaaatcatccgcgcggtcaaagccgggcagcaggggcccgagggcagcggccagcggatggcggccgccatcgcggcggacgatccagctgacggccagccccggcgggtgatcgaagggcagtatgtcctcggggccttccacctcgatcagggcgaagccggtggcgtcgggcgcgagcccctcggcgatgcgggcgatggcgggcagggcggtctcgtcccccgccagcagcaggcggcgggcgggcggcacgccgcggccgcaggggcccgacatgccgcaggtggcaccgggcaccgcccggcgggcgaaatccgcgcccgggccggcggcgtcgtgcagcacgaaatcgacctccagccagccggcagccgcatcgatccggcggatggtgtagtagcgcatggcacccgccatgccgcgggcgccccccagcggccggccgtcggggccgagcttcgggcgcggcggcggcgctccggcttcggccggaagccagagccggacatggagatcgtcatccgtcgcgaaacgggcaagatccggcccttccagcctgaggcggcgcagatgcggcccgggatcggtgatcgcggtcacccggagcaggcggtagccgtcatcgggggtgtcggtcatgcacggcgtccgatcagcagcagcagcaccggcccgccgatcagggcagcgagcaggcctgcggggatctggtaggggaagatgaccacccggccggcccagtcggcggcaagcagggtgagcccgccgaagagtgcggcaccgaccagctgttccgccggcctgaccagcccggccagacgggcgaaatgcggccccatgatgccgacgaaggcgagcgggccgaccaggatggtggcactggcggagagcagggcgaccaggagcagcagcccggcattcacccgggcgacggacatgccgagcgtgcgggcaaaccggccgcccagcggcagcaggtgcagccagcgcagcatcaggggggtgagggccagcgccgcgaggccgagaccgagcgcgagcagggcttccggcatcgaggtggcataggtcgagcccgacagccaggcgagcagctggccgagacgcggatcctggaaggtcttgagcacggcgacgaccagcccggtgatcgagcccatggcgatgccggccagcagcaggcgcaggcccgagaaagcctgacggcgggtcagcgccaggatcagcgccagcatcaggacggcgcccgcggcaccgccggcgatctgcaaaggccgggtggggcttgccgccaggaacatcaccgcgatgatgccgagcatggcgcccgaggagatgccgagcacttccggggcggcgagcgggttaccggtcatgcgctgcaggatggtgccggcaatggccagcgacagcccgccggcgaaggcggcgagcgcccgcggcaggcgataggccaggatttcgtcccaatggccggcgaccggccctgtggcatcgccggtggtcagcagcgcgccggcaaagatgatcagggtcaggccggcgatcagggcgaccagccgccaggggcgggcggcccggtggacgggcgcatggcggcgcagcgccggcggctcggccgccgccagccggggcagcaggatcagcagcagcggcgcgcccaggatcgcggtcatggcgccggtcgggaaggcgcgataggtggtgggcagcagcagcaccagctgatctgtgatcagcagcagcagggcgccgatcaccggggccgccaccagctgggcgaccgggcgccgcgccccggccagccgggcgatcgccggggcggcgagcccgatgaagctgatgatgccgaccgcggccacgatcaccgcggtcagcgcgacggcagcccccatcgccgccagccggaaccaggcgacattcaagcccaacccgcgcgcggcacgatcatccagcccaagcagggtgatcggccggatcagcagcagggtgagcagggccagcggcagcacctggccgaccaggcttcgtgtcgtctgccagtcgccctgatccagatagccggcgccccagaggaacagcccgatcagcagatcgtggttgaacagcgtgaccacggctgcggccatgccgcagaacaggctgacgatcagcccggccagcgtgaccgaaacgggggaaagcccgcgtgcggcggacagcaccagcaccaggcagaaggcgagggcggcgccgagcagggccacgccctcgcgcccgatcgcaaaggcccagggcgcctgaagcgtggcgagggtgagcgccagctgcgccccggcggaaatgccgagggtggcgggttccgccagcgggttgcgcaacacgtattgcagcatcgcccccgccagcgccagtccgccgcctgagagcagcgccacgctcacccgtggcaggaaggcgtaatgggccagaacctgcatcgtgtcggcaggggcgggggcgagcagcgcatcgggccagagggcgggcggcaccagggcggcaagattggttctgaccagcagcagcgccgcgaccgcaaagccggcgatggcgagtggaagcaggatcggcggccggcggaagggggcggtcatgcggcatgctccgcctgcagggcatcggtcagcagatgcaggaagcgcagcgccgccgggatgccgccatagaacagcacctcgggcagcagggtgacgcggccggcccggatggcgggcaggctcgacagcaccggctggcgcatggccagcgccgcgcgcaccagcggcacatgaccgatattgatcagccgcgcctcgggccgggcggccagctggtcgagcgtgacggtcagatggccgaaggccgatcccgtgcccgtccaggcattggcgatgcccagccggtccagcaccgcctggaacaggccgtcggccgtgaagaccaggcagcggcggccatcgatcaggctgatcacataggccggccgccgatcgatagccggcaggcgggctgcgccatcgaaggcggcttgcgcccgggccagatagtcgttcacctgccgctccagcccgaccgtgcgccccagaccgtcgagcgccgccatgccggtcgcgatctggtcgcggccgtcgaaggcatggggctgaaagcggtggaccggcgcgatccggttgagccgggcctccagcggtgccagttcgccatcggtcaggatggcatccggcctgagccgcgcgatgcgttccagattgggctcggcacgcaggccaagctcctgcaccccgggcgccagcgccggttcgaccacgatctgggcgtagcgcggcagttccggggcggcgaccggcatcacgcccagcgccgccagactggcggcactcacccagtccagcgccacgatgcgcggcgccccggccccggcaaaagccggaaccggggctgcaagcgcagtcgaaacaaggccgcccagaaccgtgcggcggctcggcatgcggggcgacatgttcaccaccggtaggtgaggttgcccttgatcgtccgccgctttccggcgagcaccgagttcgaatagaaaccgggggtgtagtattcctcgtcggtcagattggtgccgctcacgcccagcgacagaccggcaaggccgggatggacctgcgacaggtcatagctcgccgaggcatcgaacagtgtgtagccgtcgatgttggcctgagtgcccgtccccgtgtccatcgcagtcagggaactgccgacatagcgcagccccgcgccgatgcgcagcccggcgagtgtggcggtctggaagtcgtggttcacccagagaccagcggtgtgatagggcaccgcctgggtgcgggtgccgaccttgctgatgcccgatgcgttcggattgtccttggtgacttcggaatcggtataggcatagctggcgaccaggctccagccatcgccaaggtcacccttggcttcaagttcaaggccgcgggagcggacttcgccttcctgggtcgacagggtcggccgctgcgcgtcaggcgtgacgacattctgctgggtcagctggaacaccgatgcgctgaacatcagcccggtgccgggcggctggtagcgcaggcctgcctcgtactgttcacccgtggtcggatcgaagggccggccgtcggaataggaaccggagacaggttcgaacgacgtggaataggacagatagggggcgaagccgttatcgaacagatagccaagcccgacgcggccggagaacgcgttctgccgccgcttggtgaccgtgtcgtcgtacccgtaggcagcatagagcgtattcgaatagtaatcgtactctgagatgtcggcccagtcctggcggccgctcagcgtgacgatccacttgtcccagcggatctgatcctgcgcatagacaccgatctggctgatcagtgatttatcatcagaccacggcaagccatagacggggtcgaaatcatagttggggttcaggatgtcgatatgggcgttgttggtcgaattcgtccgggtctcgcggatgcgtgaatagccgtagttcacgccgaaggtcagatcatgggcaagcgggccggtttcgacgacgccgttgacattggcgtcggcaaccagagtgtccgaggtccgcggccgattctgcacaccgacattcacatagtggccgtcgaccaccgcgatcggccactcccaattgaaggcgctgacatagtcaagctccgcatgggtgtagcgaaggttgttgcggaaagtccaggtgtcgtcgatctcctgctcgaagacatagccgatcgtgctcgattcgacgttccagtccgtgagccctggaatgcccatatagaagtcgctcgggatcttgatgccgttcgaatagacgctgttgtcgagcggcaggctctgttccgatccgccctgggtccagttctggtattgggcgagcaaagtgagccgggtaccttcgcggctgtcgagggtgagggcgggggcgatatagaccgaatcatccttggagtgatcgatctgggtgtcggcatcgcgcttgagcgcagtcagccggtagaggatatggcgatcctcgtccagcggtccgcccagatcgatcgcgacctgcttgcggtcgaagctgccgtattcgagccggatttcgccgaacggatcctcggtcgggcgcttggtggtcatcgagaccaggccgccgggggctgcatcgccatagagcaccgacgaggggccgcgcagcacggcgacgctttccagcccatagggctcgacgaaggaatcataggggttgtagccgttgcgcagaccgtcgcgatagaagtcgcgctggctctgggcccggaagccgcgcagatacatgagcggcatgccctggccgccgggatagtcgatggcgcggatgccgggggcataggcgatggcatcgttcaggtcggtgacgccgcgatcgtccatctcctggcgggtcacgatgctgagcgattgcggcacctcgatcaccggtgtgtcggtcttggtcgcgaccgagccgttgcgggcgacatagccggtggtggcggtggccggatcattgcgaccaccccgccgccccgcctccaccatcagcgggtcgagcaccgtttcgccggcagcggcgccggcttcggcgaagagggctgcggagccgggggcgctgatccgcaccgaaattccgctgcccgaaaccaggcggcgcagagcctcttcggccgtcatgcggcccgagaccgccgtcgagttcttgcccgccaccagggccgaggaatagctgatctgccagcccgaggcgccgatgaaggcgtcgatcgcggctgcgagcggctgggcggggatggagaatgcccgggtctcggccgccgtggccggtgcggtctgctgcgcgccggcgccggccggcaccagaaccgcgcagccgagcatgctggtggtcagcagcagccgggtgagaccggcgaccccgcgccgtcgtgatgccgccatccggaatgccatgcccaaccctttcttcgtctctggtcagcggcccggcgtttcgtgttgcgggccttctgaccggttggacgcggcagggatcgggatccggcaaaaaaaatgaagatttcactccaggatgatgatgccgccgggcagtgcgcgcagcgagagaccggcggcatcggcaagaccggcaaagccggcggtgacatcgtcgagccggtagctgcccgaaacggcgagatttgcggccgcgcggtcggccaggatcacatagcccgggtgatagcgggcgaggctgtcgaccacctcgctgagcggccggtcgtggaagaccagccggccctcgcgccaggccagggcgcggcgggtgtcgaccgggcggacgggatcgatgcccgccgccgaggccacgacccgctggtccggcgccatcaccaccggcgtgcccagcccgtcgcgtcgggcgacctctacacggccgcgttccagaatgatttcgtcccggtcgtcacgcgcctcgaccgcaaaggcggtaccgagcacggtgacggtggtgaagcggccggtcaccctgaacggatgatccgggtcgtggcggacatcgaaccaggcttcgcccttgagcagggtgaccaggcgccggccgccgtcgaaatccaccgtcacggcagaggcggtgtcgagcatcatggtcgagccgtcgggcagggtgatggtggcgcgctcccccgtcgccgtgcggtgatcggcctccagccttatcatcagcgccggcccctgccagagggcgagggcggcgaagccggcggccatggcaaggccggccatccggcgcagtatcggtcggcggcgtggtgcggcggccgtcgctgcggccggcagctcctgcacggcggttgcaaaactctcggcgccccatgcggccgtgacccgccggaactcggccgcgtggcgcggatcccgggcctgccagcgggcgaattccgcccgcgtcgcggcatcggcggtgccgtcgcgcagggtcaggaaccagtcgagcgcctgatcggccgccgggtcgtcatggggttccggaccggtcgtgtccggggaaggggggtctcgtctcacgcgggggttccagtctgccgtctttcgccgtcccttttgatgagacgttcgagcggcccaattctggaaaaaagatcgccatcggtcagcttcattttcgctccagccgcgcgagcgcatcgcggcaatggccgagggcgagtttcaggtcgttgaagacggtgcgttccgagatgtcgagatggcgggcgatgcgggcattgctccagccttcgatccgcgccagcaccaccaccttctgtgtgcgctcgggcaggcgggagagggcggcgcggacatgatccagctcttcccgtgccgccaagcggtcatcggccgcgggctgatcggcggcgatgtcgcggatgtcgtggtccggcgtctcgggccgttccaccgcggcccgggtctgccgccggcgcagatgatccagcgccagattgcgggcggtgcggtgcagataggcttccatctgctcgatcgtgccgctccggtcggcatgggcggcgcggatataggtctcctgggcgaggtcttcggcgacctgcgggtcccagacgatgcgccgcacccgccggatcagggtctgccggctgtgcaggaagatctcggtgagggtggtcgtcatccgcggtggcttacccgtgcgcgcatcctcggggccgcaatggcggcccggcggggtggagaacgggcgacaccgcccggccgggccagcatagccgggcgcggacgggctgtcatagctcaattgcgaaggcgtcgcattcgcatatggagctttggcgatcgggtgtggtcaagcggtgacagccgtgctcagacggtgatgcccgcacctcggagttccgggcgaagccgcccggccagccacagcccgtacatccgccagtcgctgacgagcgaccagagtggatagctgaaggtggcggggcggttcttctcgatgaagaaatgcccgatccaggcaaagccgtagcccgagacgagtgcgccggccagccaccaccaggatccggtgacgacaagcgccagaaggcagagcagggccgccgtgctgccggcgtaatgcagcgcccggcagcgcggatcggcatgctctcgcaggtaatagggccagaactcggcgtagcgctgcggccgatcggtggggggcatgggctgcggaacctccctctcgcggcgcgtcgggcggcttcttgacgaggccctgacgcgcgggtcgtggggctcattctaccatggggcgccggggttgccgaggggggcgggtagcggcgatgctgcaaccctgcgcgaaaggctggaacccgcctgccgtggcgtgccatcctgtgcgccgcgtgatccgttgcccggggtgtggggcggcagggtccggcaggttttgcacatgtcgcgccattttgcgaaccgagcgggcgggccctctggcccgctcccgagggatcataacgtgcgcccggcggaaggtccgcgctccccggcgggccgtccaggaccggcaggcacgaccggaggacgtccaggaatgcagatgaacgatcaggcggatgaggagatgatcgccggcgcggatatcggcttcgaagcgatcgaaggcggccgcggtgtggtgatggcggccgagaccgatgcccgcggccggatgagtgctgcggcgatcgccgaccgcttcgccgacggcgtggtggtggcgctgtcggcggcgggcttcggccgccatgcgatggcggagcaggggctgtcgctcaaggtgctggcctcggccgtcgaggtggagcgggccccggcgatcggcgaggcctggcgggtcgggctgaccccggtgccggtcgaagagggcatcggcttcgcggccgagctgtccgatccgctgatgggcgatgtcttcgcccgcggcatcgtcgaggtggtgcccgaggatgcgagcggcgtgcatgccgccttccccgacgacatcgccgaccggctggccgaggcggcgatcgaaagcgccggcccggccgatgcgctgccggccggcgccggcgtggtcggcaaccgccattgcgacatcatgggccatatgaacgtgcagttctacggcgccgccttcgatcaggcgtgccggctgctgggtgtcgggctcggcctggccgagggggtggtgctgaagccggtgcgctcggtcatccgcttcaaggccgaacagcgcctgggcgatgccttccaggtgacttcgcgcccgaccatggtggcgcccgatgccatcgcggtgacccacgagctgcacaatctggagaccggcacgctctcggcctcggtcgattatgtgctccagccgatcctggccgaggacgcctcgctccgccccttcgacgatgcgacgatcgagaccgcctcgatgctgggcgccgagatcgtgggcggcatcgatatcggccccgggccttccgaaggccagggcatcagtttcgagacctatcgcggctcggtcgacccctggcattgcgacgagcacgggctggtgggcgagcagtcgctgatcgaccgggtttcgtgcgcggccggccagctgctcgacaaggtggggttgagcggcgagcggatccgccgcgaccggatcggcacggcggcggtggaataccgcatccgctatgagggcccggcccgcaacggcgacgcgctgaccctgcgcagccagatcgccggtgtgcgcgacaaggtgctggtgctccgtcaccggctgagccgcccgggcgaagaggcgaccccgctgctcgaaatcgacgtcatcgcggtgatgctggatctggagcgccgccgcgcgacccgggtgcccgacgatgtggcggcgcaggcgcgcgaactgctgatcgaggatgacgccgccgtctgaggccacgacctcgccgatgcgacaccggccccggcagcgctgccggggccggctccgtttgcggcatcagtcttcgatgatgatccgcggcggctctcgccgcacccggcccaggctttcgaccacgccggcggcgatggcgtgatagggggcggcggcctcgctctcgggggcgacggcgaccaccggccggccttcgtcggacatgatccggacgtcgagatccagcggcacggcgccgaggaaaggcaggcccagcttcagcgcctcgtcgcgcgcgccgccatggccgaagatgtcggaccgtccgccgcaatgcgggcaggtgaaccagctcatattctcgaccaggcccaggatcggcacctcgaccttgcggaacatggcgaggcccttgcgtgcatccagcagggcgatgtcctggggcgtggagacgatgacggcacccgccagcggcacgcgctgagcgatggagagctgaacgtcgccggtgccgggcggcatgtcgagcaccagcacgtcgagcggcgcccagtctgtctcacgcaggaactggtcgagcgcaccctgaaccatggggccgcgccagatcagcggcgtgtcttcctcgaccatcagcccgatcgacatggccttcaggccccagccgatcttgggcgtgatccgcttgccgtcggggctgtcgggccgcccctgaagccccagcatgcgcgggatcgaggggccatagacatcggcgtccagaatgccggtcttcagaccccgggcctggagcgccagcgccagattgacggccagcgtcgacttgccgacgccgcccttgcccgaggcgaccgcgatgatcgcggtcacccccggcaccaccggcgccgaggggcgctggccggcggcgggcccggtgggggatccggcggcggcggacccggcgggcgcgtggctgtggccatggctgtgaccgtgaccggcgccgccgcgcggcgcctggcccgggccgcgcccgggcgtgcgttcggcggtgagcaccgcggcggcgcgggtgacgccggcgacgcctgccgcggcctgttcgatctcgcggcggagcggttcggtggcggcggcacggtcgggcgtggtctcgaccatgatgcgtgcgatgccggcctcgtcgacggtcagacccgagatccggcccgaggcgaccacgtcgcggccgcgctccggatcccgtatcccggcgagcctcgacagaatctggtccctgacggtccgtgacatggttgaaaactccgagttcattgcgatatagcccggggatcgggcagttggacggccggcggttcggagatccgccgggtcgcggcggccgacgggaaaccggcggcaccggcgatataagcgcaactccgtgtccggcgccatatgtggtgccggcaggtcgcgccggaaacggtgcgggtggcgcaaagtcgaccgtcttcccatttacttccggacatgcggcagtggtatcgcatggccgggcacgccggcggcggcgcgcgaccgatggtcgcaggcccgtccgtcgcgcgacgggttcgaccacgacaagaagcggagatcagtcaagcatgccgtggaacacgccgggcggtggacagggtggcgggcctcagggcccctgggggcggggccccaacggaccgcagccaccggacctggatgagctgctgcgcagaagccaggagaaaatgcgccgggtgctgcccggcggtggtggcggcagcggcggcggccggctgatcgcgctggttgcggccgtgggggtcgcgatctggctcggcaccggtttctatcgcgtgcagccggacgagcagggcgtggagctggttttcggccggtgggtgaacaccaccacgccgggcctgcactacaactggccggcgccgatcggcgaggtctacaagcctgccgtcacccgcgtgaaccgggtggagatcggctatcgctccggcaccgatttcggccgcgccgcgggcgtgcgcgaggtcaatgccgagagcctgatgctcaccggcgacgagaacatcatcgatatcgacgtgacggtgttctggcggatcaaggacgccggcgcctatctgttcgagatccagcgccccgacactaccatcaagtcggtggccgaaagcgcgatgcgcgaggtggtcggccagacgccgctgcagttcgtgctgaccgagggccgcgcccggatcgagcagcagacccgcgagctgatccaggcgacgctcgacacctacaagtcgggcgtggaggtcacccaggtccagctgcagaaggtcgacccgccgcagcaggtcatcgatgctttccgcgacgttcaggcggcccgtgccgaccaggagcgtctgcagaacgaggccgaggcctatcgcaacagcatcctgccccgcgcccgcggcgaggccgagcgcctgatccaggaagcccaggcctatcgcgaacaggtcgtggccgatgcccagggttccgctgagcgtttcacctcgatcctgaccgcctacaacgaagccaaggacatcaccgcccggcgtctctatctggagacgatggaagacgtgatggccgggatgagcaaggtcgtgatcgagccgggcgttaccggggggcagggcggcggccagtcggtcgtgccctatctgccgctcgaccgcctgatccgcgagcccgccccgcgcaccggtgacggtgccgacatgtcgtcgtcgtccggtgccgcctcggcggcgcagggcaacgccaccaccacgccgcgctgaccgggaggaggctgaaccatgaggaagggtcttctcaccgtcggtgcgatcgtcgtcgccgccgccgccgtcgtcggcatctcgtcgacctatgtcgtccatcagaccgaacaggcgctggtgctgcagttcggtgagccgcgcaaggtggttcaggagccggggctgcacttcaagctgcccttcgtccagaacgtggtctattacgacaaccgcgtgctggatttcgacgccgacgttcaggaggtgatcgcctccgaccagaagcgtctggtggtggacagcttcgcccgcttccgcatcaccgatccgctgcgcttctatcaggcggtcggatcggaagccgtggtccgggcccggctggacagcatcgtgaacgccagcctgcgtaacgtgctgggctcggtgccgctcggcaccgtgctgaccagccagcgcgcccagctgatgagccagacggccagcatcgtgaacaacgaggccaaaagcttcggcatcgaggttctggacgtgcgcatgcgccgcgtggatctgcccgaggccaacagccaggcgatcttcaaccgcatgcggacggaacgcgagcgcgaggcgacggaactccgcgcccagggcgccgagcttgcccagcgcatccgttcgcgcgccgatcgcgagcgcacggtgctgctggcggaagcccgccgcgaatcgcagatcgcccgcggtgaaggcgatgcccaggccagccggatcttcgccgaaagcttcggcaaggatgcgcagttcttcgacttctaccgcagccttcaggcctatcgcacggcgctcggcaattccgacaccaccatggtgctgacgccggacggcgacttcttccgctatttcggtgccgacggccaacttcgcctgccaggccagacgcccgccgccggcaactgacccggcgcctaccgcacgcgaagacgatccgacggccgccccgggtaaccggggcggccgttggtcgttgagcatgaggtcgaggggccgtcagccggtctggtgcggggcttgcgcgcgcccgatctgcgcgccacctttatctcttaagacagaaggcggatgagggcagaaggcggatgagggcagaaggcggatgaggtcaggatgagccgtgttgccatcaaggtgttgacgaccgtgaccgctccctacggaggggcgctgtccgcgcatgatctggccggccggatcgccgatcccggcagtgccgagcgctgtgatccgctggttttcgccttcttctccgaagtcagccccaggctgcagcaggctttcatcgacgagatgcatgtcgatccgacggccgcgcggcaggttgcttcgcggttttccgaactggcggggtatagcctgccctttgccgacgagagccgtttcgcagcctgatcagacggacagtgacatcaccggccggaccgtcacaccaccgggttgggcatctcgcgatgcaccgcctcgatcgcctggagcaggtcggggctgaggtcgatatcggcggcggcgaggatcggggccagctggtcggggcgggagacgccgggcagggcggaggcgatgcccggccggccgagggtccaggcgacggccatggtcgccggatgcaggccgtgctcgcgggcgagggcgacataacgatcggcggcagcgatggcgcgggcatggccgtagcgggcctggaagcgcggcgggaaggcgttcagccgggcctcggggccggcaccgccggtggcgccgtatttgccggtcagcacgcccatggcgatgggcgagaaggcgagcatgccgatgccctcgttcacgcagacttccgacatgccgtcgtcatagacccgcttcagcaggtgatagacgttctgcagcgacacgattcgggcggtgccgagcgcttcggcccgggccgccagacgggtgaggccccagggcgtctcgttgctgacgcccagatagcggaccttgccggcccgcaccagccggtcgagcgcttcgagctgatcgtccatcggcgtcacgcggtcgggccaatgggtctggtagagatcgatcacgtcggtgccgagccgtttcaggctttcctccaccgcgcgttcgatatggaagcggtcgagcgcacagagcccgccgcggatatggccgacgatgccgcggcccggcccgtcgcccgggcccgacaccttggtcgccacgatcacccggtcgcgcggcaccgtcttcaggaaggcaccgaggatgcgttcgctggcaccctgggtctcgggcgtctggggcacggcatacatttcggcggtgtcgaacagggtcacgccggcctcgaaggcctcggccatgatccgcaccgatgtccgctcgtcgagctgcgagccgaaggtcatggtgccgagcgagatttccgaaaccagaagaccgctccggccgaggcgccgatatcgcatgaaatgctccgtcacggatgggcatggaccgcgcccgttgccgggcgggcgcaagcttgctacaggtgatagggactgtccaccatgcctccgccgaccggttccgccgacgacgctgccgcatccgtggtccactccgccccgcagaccaccgtctcgaggagcccggcatgaacgacctgctgaccgccatcggcctcgtgctggtgttcgagggtgccgtctacgcattgtttccgcgcggaatgaagcggatgatcgtggcggtgctggccgaaccggaggatcgcctccgggtgggcggcgcggtgatcgcggccatcggcgtcggccttgtatggtggctgcgcggatagcgcctgcgtgcatccgcgcttgatccaccccggccccccgcctacatcggatcttcgtagcctgccggcaacgtatcagggagacaatcacgtgccagcttcccttccgcaccggatcttctcgggtctggcggcgcttaccatcgccacctgcgtggcgctcggtgccggtccggcggatgcgcgcccggcgcccgaaagcttcgccgatctggtagagaagctgaccccggcggtggtcaacatctcgaccacccagaatgtcgaggtgcagggcccgcagatcccgatcccccagtttcccccgggatcgcccttcgaagacctgttccgcgacttcttcggcgaccgcagcggcccgggtggtggcacgcgcaaggtgacggcgctgggctccggcttcgtgatagatgcgggcggcctggtcgtgaccaacaatcacgtcatcaaggatgccgacgagatttcggtgatcctgaccgacaataccgagctgccggcggaagtggtcggtaccgaccccaagaccgatctggccgtgctccgggtgaagtcgccgaagccgctgccggccgtcgcctggggcgacagcgcgaagtcgcgggtgggcgactgggtgatcgcggtcggcaacccgttcggcctgggcggctctgtcaccgccggcatcatctcggccagggcccgcgacatcaatgtcggccccttcgacgacttcctgcagaccgatgccgccatcaaccgcggcaattccggtggcccgatgttcaacatggccggtgaggtcatcggcatcaacaccgcgatcttctcgcccaccggcggctcggtcggcatcggcttcgccgtgccgtcggaactggcccgtccggtgatcgagcagctggtcgaatacggccgcacccgccgcggctggctgggcgtgcagatccagccggtcacgcccgacatcgccgaaagcctgtcgctggacaaggcccatggcgcgctggtcgcccgcgtgatgcccgacagccccgccgccaaggccgggatcgaggtcggcgacgtggtgctgcgcttcgacggcaaggacgtgaccgagatgcgcgaactgccccgcatcgtggccgagaccgagatcaaccgctcggtgccggtcgaggtgtggcgcaatggccgcaagatcgaggtgaaggtcaccgtgggcgagctggacgagagcgacctcgcccaggcgaccgaagagcccggccaggagcaggcgccccagggcaccggcaccaaggtggcggcgcttggcctgaccgtcgcccaggcggatggcgcggtgcgcgaccgcttcggcctgggggccgatgtcgagggcgtggtgatcaccgagatcgacgccaacgggccggccgacgacaagccgatccgcgtcggcgacgtgatcgtcgatatcggccagcgcaaggtggagaaggttgccgacatcgaggcggcgatcaaggaagcccgcgatgccggtcgcaagtcggtgctgctgctggtccgtaccggcgacgacagccgcttcgtcgcgatccgcctgaaggattgacgacggcgggccctgcggcctgaaacgaaccaagccccgcccggatcgatccgggcggggctttgctttagaacgccggcggtgctcagtccgcgaccaggaactcgtcgcgggcatagccctgcaggtagagcagggcggtcaggtcgccgtgattgatccgcaccggtgcggccgcggccacccgcggcttggcgtgataggcgacgccgaggcccgcctgcacgatcatcggcaggtcgttggcaccgtcgccgaccgccagcgcgccgccgagcccgccggcccagagcccggcatagtgatccagcgcctcgaccttggcatcggcgcccaggatcggcgggatcacccggccggtcagccgcccgtcctcgatttcaaggacattggcgcgatggtcgtcgaagccgcaaagcgctgccacccgggcggtgaaataggtgaacccgcccgagaccagcaccgcgcgggcgccctggctgcgcatggtggcgaccagggtgcgggcgccgggcatcagccgcacccgctcgccaaaggcgcgcgccagtacgccgtcggcgagcccggcgagggttgcaacccgggcggtcagcgcttcggcgaaatccagctcgccgcgcatcgcccgctcggtgactgccgagacctcggccttcaccccggcgaaatcggccagctcgtcgatgcattcgcaggtgatcatggtgctgtccatgtcggacaccagcagccggcggcggcgcgtgggcccgtccggctgtgccgcggcatccaccggcagcccggcgccggcaagggcggcctctgcggcatcgcccacggcggcggcctctccctcggccgcaatgtcgacggccacgccgtcatgcagcgccgtgaccgtgcccgtggcatggcccgcggcttcgaccgcgcgacgcaccagatcgatggtgccctggtcgagcacggtttcgccgctgccggccttgacgggatcgccgatcagcgtcaacacggttcccatgggatcgtcccttcatccaaacaccgggcgcattaaaagcgccggaccgcgcgggagcaagcatgcagcggagcaatccggcaccggccggcgccggccccctgatcgtggtgatgggccccaccgcctcgggcaagtcgcagctggcgctcgacctcgcccgggcacgcgacggcgtggtgatcaatgccgatgcgatgcaggtctatgccgatctgcggatcgtgaccgcgcggccctccgaggtcgacgaggccgccgccccccaccggctctatggcgtgcggccggccgaggcggtgtggtcggccgccgactgggcggcggccgcgcgggccgagattgcagctgcgcatgaggcgggacgtctgccgctgatcaccggcgggaccggcctttacatccgtgcgcttgtggaggggctgtcggatctgcccgcgatcccgcaggatctgcgcgacgaggtccgcgcgctgggcctggccggcggcgtgccggcgctgaaggcggcgctggcaccgctcgaccccgaggcggcgcagcggctggcggacccgcagcgcctggcccgggcgctggaggtggtgcgtgccaccggccgcagcctggcggactggcagcgcgctcatccgcccgcgggcggccatgcgggcccggtcttcaccatcgcgctgatgccggatgccggaacccgcgaccgggcgatcgccggccgcttcgtgaagatgctggagatgggggcggccgatgaagtcgcagccttcctggcgcgcgggctggatccgcaggccgtgccgctgatgaaggcggtgggcgtgcccgagatcggcgcctggctggcgggggagatttcgcgggacgagatgctggagcggggccgcgtcgccacccgccaatacgccaagcgtcagatgacctggatacgaaatcaggcgcacatcaacctgggcgcgcatgagcaatattcggaatgtttggcatcaagaatctttttggaaattgatctcttcctgttgaccctgggtcattgagccgctaggttccacaggctcggatcagagaccggtcgagatccgcctgcccgtatgccatgggcagggcgggaccgggccccgcatcgaggtgaggggcggaacccgccgacggagatgtccgccggcggttctttttcggcgaaggccggcggatgtcccgccggtgatccgggcgagggcgggccctgcgctgcgcatgccccccgaaccagatgttacgcggagcgaccgaacgatgcagttcaccggtgcggaaattctgatcaaagccctggccgaccagggtgtggaggtcattttcggctatcccggtggcgcggtacttccgatctatgacgcgctctacaagcagaacagcgtgcgtcattacctggtccgccacgaacaggcggcggtccatgcggcggaggggtatgcgcgctcgaccggcaaggtcggcgtggtactcgtgacctcgggcccgggggcgaccaatgcggtcaccggcctgacggatgcgctgatggacagcattccgatcgtctgcctgaccggccaggtgccgacccatatgatcggcaacgatgccttccaggaggcggataccgtcggcatcacccggccctgcaccaagcacaattatctgatccgcgacgtcaacgtgctggcggcgaaggtccacgaggccttccatgtcgcgcgctcgggccgccccggcccggtcgtgatcgacctgcccaaggacgtgctgaacacgctggccgcctataccgcccccgatgccctgccggcgccgacctaccggccccaggtcacgcccgaacaggcggcgatcgaacgcgcggtcgatctgatgctgaaggccgaccgcccggtgttctatgtcggcggcggcgtgatcaatgccggcaccgaggcctgcgacaacctggtccgcctggtgcgtgccaccggctttcccatcaccatgaccctgatgggcctcggcgcctatccggccagcgaccggcagtcgctgggcatgctgggcatgcacggcacgctggaagccaatctggcgatgcatggcagcgatctgatgatcaatctgggcgcccggttcgacgaccgggtgaccggccggctcgacggcttctcgcccgacagcatcaagatccatgccgatatcgacccgtcttcgatcaacaagaacgtggcggtcgacctgccgatcgtgggcgatgccggcaacaccatccgggcgctgctggaggtgtgggagcgccgcaaggccgagcatgatcccgcgcgcatcggcgactggtgggagaagatctcgggctggcgggcgcagaactcgctgggcttccagaacagcgcccagatcatcaagccgcaatacgcgatccgccggctgtgggagatgacccgcgaccgcaacccctacatcaccaccgaggtcggccagcaccagatgtgggcggcccagcatttcggcttcgaccagccgaaccactggatgacctcgggcgggctcggcaccatgggctatggcctgccggcggcgatgggcgtgcaggtggcgcatcccgatgcgctggtgatcgacatcgccggcgaagcctcgacgatgatgaacatccaggagctgtcgagcctgatccagcatcggttgccggtgaaggtgttcatcctgaacaacgaatggatgggcatggtccgccagtggcaggagctgttccatggcggccgctattccgaaagctattcggcggcgctgcccgatttcgtgaagctggccgaggccttcggtgccaaggggctgcgcgcccattcgcccgacgatctcgacgatgtgatccgcgagatgctggcccatgacgggccggtggtggtcgatgtccgcgtcgacaagggcgagaacgtctatccgatgatcccggccggtgccgcgcatcacgagatcatcctgggccccggccaggagctggacgcctgcaagagcgaggacggcatggtactggtctgagctgcgggcggcaccgcagcggccacgccagttcccggcaggcttcgaacaggcctgccgccttcttccgtccgggttaagaccggctccaggcgcgagacagcttcccatggtcatcaagaacgaacccatcacccagcacacgatctcggtgctggtcgacaacgaaagcggcgtgctcgcccgcgtcatcggcctgttctcgggccgcggctacaacatcgacagcctgacggtggccgaggtgaacgaggcgcgcacccgctcgcgcattaccatcgtcacctcgggcacgccgatgatcatcgagcagatcaaggcgcagctcacccggctggtgccggtgcatgcggtgaccgacctgacccagagcgggcctttcgtcggccgcgagctggcgctggtcaaggtcgcttgcacgggggatcgccgggtcgagtcgctgcgcatcgccgatatcttccgcgcccgggtggtcgacagcacccatgaaagcttcatcttcgagatgaccggttcgaccgagaagatcgaggccttcatcaacctgatgcggccgctggggctggcggatgtggcgcgcaccggcatcgcggccctgtcgcgcggggcggccccgctcgcctccgagcgcgggcgcgtctgatccgaccggctttcgggccttggggagaccccgggtccaccattcgacaccttaggtccatatggcgtcgtgcgtggtcgaaattgatcgcgaggcgtgcgacgacaaggtcaagggcggcgggatgcagaacaggccgcccattgacatcatcagaggaagcaaccgaaccatgcgcgtctactacgatcgcgatgccgacctgaacctgatcaagaccaagacggttgcgatcatcggctatggcagccagggccatgcccatgcggcaaacctccgcgacagcggcatcaacgtgatcgtgggcctgcgtgcgggctccgcgacccgtgccaaggccgagggcgccggcttcgccgtccacacccccgacgaggccgcgaagctggccgacgtggtgatggtgctcaccccggacgagctgcatgccgagctctacgagcaggatctgcgcgacaatctgaaggagggcgccgcccttgtcgtcgcccatggtctgtcgatccatttcggtctgatccagccgcgcgccgatatcgacgtgttcatgatcgcgccgaagggccccggccacacggtgcgcagcgaatacctgaagggcggcggcgtgccgagcctggtggccgtggcgcaggacgtgtcgggcaatgcgctcgagaccgcgctctcctatgcctgcggcctgggtgccggccgcgccggcatcatcgagaccaccttcaaggaagagtgcgagaccgacctgttcggtgagcaggccgtgctctgcggcggcgtgacccacctgatcaccgccggcttcgagaccctggtcgaggcgggctatgcccccgagatggcctatttcgagtgcctgcacgagatgaagctgatcgtcgacctcatgtatgagggcggcatcgccaacatgcgctactcgatctcgaacaccgccgaatacggcgactacgtgtcgggtccgcgggtcatcaccccggccgtgaaggccgagatgaagaagatcctggaagacatccagggcggccgcttcacccgcgactgggtgctggagaacgccgcccgtcagtcgagcttcaaggccatgcgtcgccgcaatgccgagcaccagatcgaagagatcggtgagaagctgcgcgccatgatgccctggatcgcggctaaccgcctggtcgacaagaccaagaactgatctgatccttccggaccggatgcagacgggcggcatgccacaagggcatgccgcccgtctgccgtttccggccccggaacctgcggccgctctaccggttatgagacgggtgcaggaacggaggcagagaatgacggcagaggacggccggaccggcacgctgcgcggccaggccgaaagcgggctcgatccggatggcgcaccggccgagcacgaggcccggggccgccacgcccgggggccggacgagatgccgatgcggggctggaaggatgtcctctggcgcaccgtccggcaggtgatcgaggatcgggtggaggccgtggcggcgggcgtcgccttctataccctgctcgccatcttcccgggcatcaccgcgctgatctcgatctatggcctgttcgctgatccggcggcggtggtggagcatatgaccctgctgggcgatgtgctgcccgccggccccgtgcagctgatgtccgagcagatgctgcgggtctcccgccagccccaggggcagctgggcttcggggcgctgttcagcctcgccattgccctctggagcgccaatcagggcatgaaggcgatgttcgatgcgctcgacgtcgcctatggcgagcggcagtcgcgctctttcgtggtcttcaccgccgtcacgctggggttcacccttgcggccatcctgtcgacggcgctggtgctggcggcccttgccctgttgccggtggcgctggatgtgctgccgctcggcacctcggccgaacagctgctcgatatcggccgctggcccctgctggtgctgatcgtggtgctgggcaccagcgtgctctatcgctatgccccgagccgcagaaccgcccactggcgttgggtcacccccggcggctgtctggcggccgtggtctggctgatcgcctccatggccttctcctggtatgtggccaaccttgccggctatgaccgcatgtatggaccattgggggcggtggtggtgttcatgacctggatctggatctcggtcatgatcgtgctggtcggcgccgaactgaatgccgaactggaacaccagaccgcctgcgactcgaccgaaggccagcccaagcctatggggcaccgcggggcctatgtcgccgataccctgggcaagctgccctgagacccgccccagggtgcgggcggccatcagaagcccgccccgggctcttccagatagacctgctcctccggcgtcgagacccggcccagcacctcgttgcgatggggatagcggccgaagcgttccagcaccgccagatgacgccgttcccagtcgagcgcatcggcatcgcccagtgccgtgaacagggccatcgcctgaacatgcacgctcaggctctcggaatgctcgaagggcagatagaggaacttgcgctcggtgacggtgagcttcagatcgtggccgccggcaaccgcttcctgggccagggccagcgccatgccgtcggcggcgaaggcgtccggcgtgccgcggtggatgtggcgcgagaactggtcgagcaccaggatttccgccagccggccgcggggcgtgctgcgccagggggcgcaacaaccgcggcgggcggcggccagaacccggccgaagcgatcgccgatcacctcgtccaggcgctcgccggcgccgaaccagtcgctggggccgagttcgccgaaccagtagtccagcacgcggtcgagtgtggcgccgtcggcgatcacggcttcttcggcgcgcagcgccgtggcgaggtcggtgagcatgggggcgggctccggagggggaggggaatgtcatccatcgtctcgcgaaacccgcccgggctcaaccgtcgacacttggccggcgtcgacaaccgaccggatcaatgggtgaggctgtgcgccctctccaatgccgcggcttcgtcgggtgccacatgcagcgggaaggggaaggcggctgccacctgggcggtcttggctgccagctcctcaatctctgccggatcggccggcagatagacgaaaccgccgcagcgtgcggcgagatcctcacggcgctgcttcatccacaggatgaccttcttgcgcccctcggtcagcgtggcggcatcggcggtgatggtgcccggcatatccatcaccacggcaaagcgctgcccgctgtccaggatcagggtgagggcgtcgatccaggcctcgaccatggcaagatcgccggcgggggagcggccgcggacgacgggccagcaggagagatcgaagccggcggttccaaggacgggggcgtcgggcggggtgatggtcatcgatctggtctttccgaagggggctacgagaaaaaaacagcctgcggcatctgcggcgatgccgccacccggatcggggcgaaagacctctgggatcggctcaagaatctttcgtgtcggatcaacggcttgccgggcgaatcgtccaccgtcaaaaaaaccgtcaaaaaaggtgttgccagggttggcttgggcccttataaaccgccccacaccgacgggcaccgcggaggacgcggcgccgggcggggctgaaaagccagagaatacagcctcttaaacgaggcaggcccttaagaggggcaggcgcccgagggtgccgcggggcgggaacgcttcgtcaggatctttgacattgtgaaacggatcggaagggatgcgagggcggcggtcgtcgatcttaggactttaagaacgactgaccgatgagcgccttggcatctcgatatgaccttgtgcctagagagatgccgggacgattttcggttgaagccttgttgtgtgagcgatcatgcagcgaaggttcaacttgagagtttgatcctggctcagaacgaacgctggcggcatgcctaacacatgcaagtcgaacggggtcgggacttcggttccggcttacgtggcgcacgggtgagtaacacgtgggaatctgcccatctatggggaataactgcgggaaactgcagctaataccgcatacgcccttcgggggaaaggcttcggccgtagatggatgagcccgcgtccgattagctagttggtggggtaacggcctaccaaggcgacgatcggtagctggtctgagaggatgatcagccacactgggactgagacacggcccagactcctacgggaggcagcagtggggaatattggacaatgggcgaaagcctgatccagcaatgccgcgtgagtgatgaaggtcttcggattgtaaagctctttcgacggggaagataatgacggtacccgtagaagaagccccggctaacttcgtgccagcagccgcggtaatacgaagggggctagcgttgttcggatttactgggcgtaaagcgtgcgtaggcggcttatcaagtcagaagtgaaagcccggggctcaactccggaactgcttttgagactggtaggctggagttcgggagagggtagtggaattcccagtgtagaggtgaaattcgtagatattgggaagaacaccggtggcgaaggcggctgcctggcccgaaactgacgctgaggcacgaaagcgtggggagcaaacaggattagataccctggtagtccacgccgtaaacgatgagtgctggacgttgggatacttagtatcgcagtgtcgtagctaacgcgttaagcactccgcctggggagtacggccgcaaggttaaaactcaaaggaattgacgggggcccgcacaagcggtggagcatgtggtttaattcgaagcaacgcgcagaaccttaccagcccttgacatggacgtcgcgaccctggagacggggttttcggttcggccggacgtcacacaggtgctgcatggctgtcgtcagctcgtgtcgtgagatgttgggttaagtcccgcaacgagcgcaaccctcatccttagttgccatcagttcggctgggcactctagggaaactgccggtgataagccggaggaaggtggggatgacgtcaagtcctcatggcccttatgggctgggctacacacgtgctacaatggcgactacagtgggcagcgacatcgcgaggtgaagctaatctcaaaaagtcgtctcagttcggattgtactctgcaactcgagtgcatgaagtcggaatcgctagtaatcgcggaacagcatgccgcggtgaatacgttcccgggccttgtacacaccgcccgtcacaccatgggagttggttttacccgaagccggtgagctgacccgcaagggaggcagccgtccacggtaaggtcagcgactggggtgaagtcgtaacaaggtagccgtaggggaacctgtggctggatcacctcctttctaaggaagacgcccgccgtccccgcatcccttccgcatcgaacgcagtcaagcgggcctgtagctcaggtggttagagcacacgcctgataagcgtgaggtcggtggttcgagtccacccgggcccaccatctgccttgcttgtcctggaggcacctgtccttgagacgggcccttgacgttggttcgatgcaggaagcgagaaggtttcggccctgttcttcggaacgggatgccgggatcgggtttccgatccgtgaaccgggatccttttggatcaccggcgatgttctttgacagtgtgaagagatgagatcgtctgatgtatgcgagctgagtggccgcgcgtcggaacctcgaaggatgaccgcgccggtttgcaggagtgcaaacggatcgcgggtccggttctggacgtggcggcggatctctcgagcaagagaagggcatctggtggatgccttggcgtcaggaggcgatgaaggacgtgacacgctgcgataagccgtggggagctgcgagtaagctttgatccatggatttccgaatggggcaacccaccgcttcggcggtatcttctggtgaatacatagccaggagaggcgaacccggtgaactgaaacatctaagtagccggaggaaaggacatcaacggagactccgtaagtagtggcgagcgaaagcggatcaggccagtggtcctttgtgcgacgatcagaacggcatggaaaggccggccagagcgggtgatagccccgtatggagagttgcgcactggatccttgagtagagcgggacacgtgaaatcctgttcgaagatggggggaccaccctccaagcctaagtactccctgacgaccgatagtgaaccagtaccgtgagggaaaggtgaaaagcaccccgacgaggggagtgaaacagttcctgaaaccggatgcctacaagcagtcggagggcgcaagcctgacggcgtaccttttgcataatgggtcagcgagttactttatccagcaagcttaagccgataggtgtaggcgcagcgaaagcgagtctgaacagggcgtttgagttggatgaagtagacccgaaaccgggtgatctagccatgggcaggttgaaggtgcggtaacacgcactggaggaccgaacccacgtctgttgaaaaagacggggatgacctgtggctaggggtgaaaggccaatcaaactcggatatagctggttctccgcgaaaactatttaggtagtgcgtcacgtgattacccctgggggtagagcactggatgggctagggggcctcaccggcttaccaaacctaaccaaactccgaataccagggagtacagcgtggcagacagactgcgggtgctaaggtccgtagtcgagagggaaacagcccagaccaccagctaaggtccccaagttgcggctaagtgggaaaggatgtaggacggccatgacaaccaggaggttggcttagaagcagccatcctttaaagaaagcgtaacagctcactggtctagataagctgtcccgcgccgaagatgtaacggggctaaagccgtacaccgaagctgtggatgcaccgtatggtgcgtggtagcggagcgttccgtaggcctgtgaagggtgacccgtgagggcgcctggaggtatcggaagtgagaatgctgacatgagtagcgacaaacagagtgagaaactctgtcgccgaaagcccaagggttcctgcgcaaggctaatccgcgcagggtgagtcggcccctaagacgagggcgaaagccgtagtcgatgggaagcaggttaatattcctgcacctgtgggaagtgacggatgatgtaagttgtcggggcttattggattgttcccggcagcgaagttgttccaggaaataactcccacgtacagaccgtacccgaaaccgacacaggtgggctggtagagtataccaaggcgcttgagagaacgatactgaaggaactcggcaaattacccccgtaacttcgggagaagggggccccgttcctgggcaaccaggggcggggggcacagaccagggggtggcgactgtttactaaaaacacagggctctgcgaagccgcaaggcgacgtatagggtctgacgcctgcccggtgccggaaggttaagaggaggggttcacgctctgaatcgaagccccggtaaacggcggccgtaactataacggtcctaaggtagcgaaattccttgtcgggtaagttccgacccgcacgaatggcgtaacgacttccccactgtctccagtatcgactcagcgaaattgaattctccgtgaagatgcggagttcccgcggtcagacggaaagaccccgtgcacctttactacagctttgcagtggcactagggactgaatgtgtaggataggtgggagcctatgaagccgcggcgccagccgaggtggaggcaaccttgaaataccacccttttggttcttggtgtctaaccgcgctccgtgatccggagccgggaccctgcatggcgggtagtttgactggggcggtcgcctcccaaagagtaacggaggcgcgcgatggtgggctcaaaccggtcggaaatcggttgtcgagtgcaatggcataagcccgcctgactgcgagactgacaagtcgagcagagacgaaagtcggccatagtgatccggtggtcccgagtggaagggccatcgctcaacggataaaaggtacgccggggataacaggctgataacccccaagagtccatatcgacggggttgtttggcacctcgatgtcggctcatcacatcctggggctggagcaggtcccaagggttcggctgttcgccgattaaagtggtacgtgagctgggtttagaacgtcgtgagacagttcggtccctatctgccgtgggtgtaggagacttgagaggatctgtcctcagtacgagaggaccgggatggacggacctctggtgcaccagttgtgacgccagtcgcatcgctgggtagctatgtccggaagggataaccgctgaaagcatctaagcgggaaacctccctcaaaaccaggtctcccttgagagccgtggaagaccaccacgtcgataggccgggtgtgtaagcgcagcaatgcgctgagctgaccggtactaatcgctcgatcggctcgaaagatccccgccgcgcccagaaccgggcccgcggcccacgaagcttgcacacacatcatcaaatcagacgatctcgcgctcagagcttccggaagcacaacttccggactgtccctccgtgcggtttcatgacctggtggctatggcggacgtgaaccacccgatcccatcccgaactcggccgtgaaaccgtcctgcgccgatggtacttcgtcttaagacgcgggagagtaggtcgctgccaggtcttgtaaccgcatggatggacagacaacgctcaccacaacaaagcgcgatctcatctcaatccacactgccaaccgcctacgccctgacgcggggtggagcagcccggtagctcgtcaggctcataacctgaaggtcgcaggttcaaatcctgcccccgcaaccaaggctcaccacaacaaagcgcgatctcatctcaatccacactgccaaccgcctacgccctgacgcggggtggagcagcccggtagctcgtcaggctcataacctgaaggtcgcaggttcaaatcctgcccccgcaaccaagctttcagcaaacgccgccccggcctctcgccgcgggcggcgttgctgcgtttaggcgctgcctttctctctctccgctgccaggcagggcagggcgacggcatccctaaaagaacacgggggtcagcgggggcccccggcccccgcgatcttccttccttctccaacgccccttattgtcgttatccgcacccgacgcgcagagcttatgcaaaggccggaca
